United States Patent
Spidel et al.

(10) Patent No.: US 10,941,431 B2
(45) Date of Patent: Mar. 9, 2021

(54) LYSINE CONJUGATED IMMUNOGLOBULINS

(71) Applicant: Eisai R&D Management Co., Ltd., Tokyo (JP)

(72) Inventors: Jared Spidel, Downingtown, PA (US); Earl Albone, Blue Bell, PA (US)

(73) Assignee: Eisai R&D Management Co., Ltd., Tokyo (JP)

(*) Notice: Subject to any disclaimer, the term of this patent is extended or adjusted under 35 U.S.C. 154(b) by 454 days.

(21) Appl. No.: 15/662,981

(22) Filed: Jul. 28, 2017

(65) Prior Publication Data
US 2018/0044711 A1   Feb. 15, 2018

Related U.S. Application Data

(63) Continuation of application No. PCT/JP2017/021672, filed on Jun. 12, 2017.

(60) Provisional application No. 62/348,410, filed on Jun. 10, 2016.

(51) Int. Cl.
*C12P 21/02* (2006.01)
*C07K 16/00* (2006.01)
*A61K 47/68* (2017.01)

(52) U.S. Cl.
CPC .............. *C12P 21/02* (2013.01); *A61K 47/68* (2017.08); *A61K 47/6803* (2017.08); *A61K 47/6811* (2017.08); *C07K 16/00* (2013.01); *C12Y 203/02013* (2013.01); *C07K 2317/40* (2013.01); *C07K 2317/41* (2013.01); *C07K 2317/51* (2013.01); *C07K 2317/515* (2013.01); *C07K 2317/52* (2013.01); *C07K 2317/522* (2013.01); *C07K 2317/524* (2013.01); *C07K 2317/53* (2013.01); *C07K 2317/55* (2013.01)

(58) Field of Classification Search
None
See application file for complete search history.

(56) References Cited

U.S. PATENT DOCUMENTS

2020/0009263 A1    1/2020   Spidel et al.

FOREIGN PATENT DOCUMENTS

WO    2013/176516 A1    11/2013
WO    2017/106643 A1    6/2017

OTHER PUBLICATIONS

Mindt et al., Bioconjugate Chem., vol. 19, No. 1, 2008 (Year: 2008).*
Senter et al., The discovery and development of brentuximab vedotin for use in relapsed Hodgkin lymphoma and systemic anaplastic large cell lymphoma. Nat Biotechnol. Jul. 10, 2012;30(7):631-7.
U.S. Appl. No. 16/062,831, filed Jun. 15, 2018.
Behrens et al., Methods for site-specific drug conjugation to antibodies. MAbs. Jan.-Feb. 2014;6(1):46-53.
Dennler et al., Transglutaminase-based chemo-enzymatic conjugation approach yields homogeneous antibody-drug conjugates. Bioconjug Chem. Mar. 19, 2014;25(3):569-78.

(Continued)

Primary Examiner — Karl J Puttlitz
(74) Attorney, Agent, or Firm — McCarter & English, LLP; Marcie B. Clarke

(57) ABSTRACT

Provided herein are conjugated immunoglobulins and methods for generating conjugated immunoglobulins using a microbial transglutaminase.

25 Claims, 15 Drawing Sheets
Specification includes a Sequence Listing.

(56) References Cited

OTHER PUBLICATIONS

Deonarain et al., Emerging formats for next-generation antibody drug conjugates. Expert Opin Drug Discov. May 2015;10(5):463-81.
Groenen et al., The amine-donor substrate specificity of tissue-type transglutaminase. Influence of amino acid residues flanking the amine-donor lysine residue. Eur J Biochem. Mar. 15, 1994;220(3):795-9.
Gundersen et al., Microbial transglutaminase displays broad acyl-acceptor substrate specificity. Appl Microbiol Biotechnol. Jan. 2014;98(1)219-30.
Jeger et al., Site-specific and stoichiometric modification of antibodies by bacterial transglutaminase. Angew Chem Int Ed Engl. Dec. 17, 2010;49(51):9995-7.
Josten et al., Use of microbial transglutaminase for the enzymatic biotinylation of antibodies. J Immunol Methods. Jun. 23, 2000;240(1-2):47-54.
Mccombs et al., Antibody drug conjugates: design and selection of linker, payload and conjugation chemistry. AAPS J. Mar. 2015;17(2):339-51.
Mindt et al., Modification of different IgG1 antibodies via glutamine and lysine using bacterial and human tissue transglutaminase. Bioconjug Chem. Jan. 2008;19(1):271-8.
Ohtsuka et al., Comparison of substrate specificities of transglutaminases using synthetic peptides as acyl donors. Biosci Biotechnol Biochem. Dec. 2000;64(12):2608-13.
Ohtsuka et al., Substrate specificities of microbial transglutaminase for primary amines. J Agric Food Chem. Dec. 2000;48(12):6230-3.
Siegmund et al., Locked by Design: A Conformationally Constrained Transglutaminase Tag Enables Efficient Site-Specific Conjugation. Angew Chem Int Ed Engl. Nov. 2, 2015;54(45):13420-4.
Sochaj et al., Current methods for the synthesis of homogeneous antibody-drug conjugates. Biotechnol Adv. Nov. 1, 2015;33(6 Pt 1):775-84.
Spidel et al., Site-Specific Conjugation to Native and Engineered Lysines in Human Immunoglobulins by Microbial Transglutaminase. Bioconjug Chem. Sep. 20, 2017;28(9):2471-84.
Strop et al., Location matters: site of conjugation modulates stability and pharmacokinetics of antibody drug conjugates. Chem Biol. Feb. 21, 2013;20(2):161-7.
Sugimura et al., Identification of preferred substrate sequences of microbial transglutaminase from Streptomyces mobaraensis using a phage-displayed peptide library. Arch Biochem Biophys. Sep. 15, 2008;477(2):379-83.
Tagami et al., Substrate specificity of microbial transglutaminase as revealed by three-dimensional docking simulation and mutagenesis. Protein Eng Des Sel. Dec. 2009;22(12):747-52.
Taguchi et al., Substrate specificity analysis of microbial transglutaminase using proteinaceous protease inhibitors as natural model substrates. J Biochem. Sep. 2000;128(3):415-25.
International Search Report and Written Opinion for Application No. PCT/JP2017/021672, dated Sep. 14, 2017. 11 pages.
International Search Report and Written Opinion for Application No. PCT/US2016/067165, dated May 2, 2017. 8 pages.
Harris, Processing of C-terminal lysine and arginine residues of proteins isolated from mammalian cell culture. J Chromatogr A. Jun. 23, 1995;705(1):129-34.
Kline et al., Methods to Make Homogenous Antibody Drug Conjugates. Pharm Res. Nov. 2015;32(11):3480-93.
Van Den Bremer et al., Human IgG is produced in a pro-form that requires clipping of C-terminal lysines for maximal complement activation. MAbs. 2015;7(4):672-80.

* cited by examiner

FIG. 2

| | |
|---|---|
| Z-Gln-Gly | |
| Z-Gln-Gly-CAD-Biotin | |
| Z-Gln-Gly-N₃ | |
| Z-Gln-Gly-PEG₂-BCN | |
| Z-Gln-Gly-PEG₂-Auristatin F | |

FIG. 4
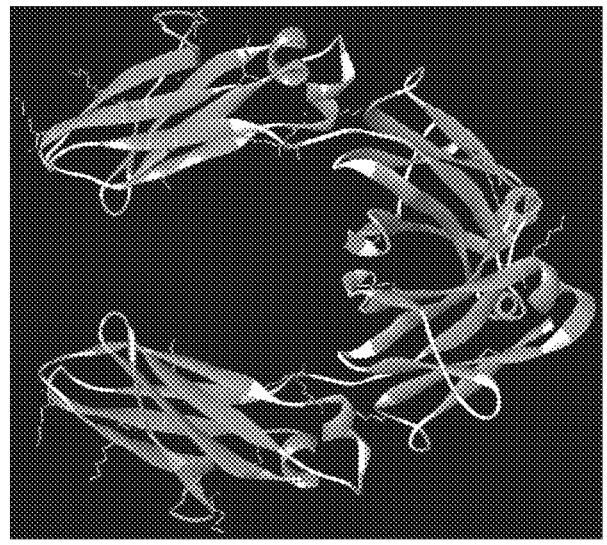
C  Fc
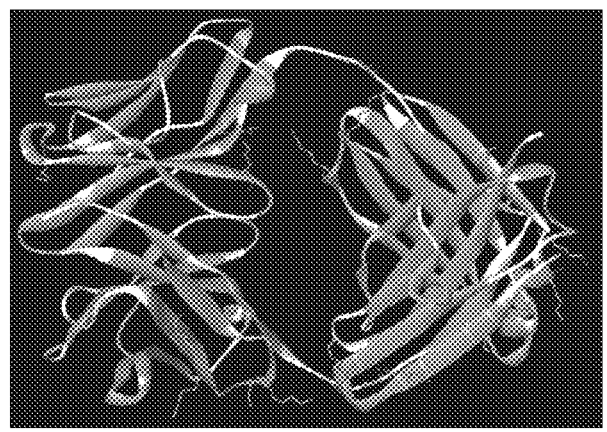
B  Fab-lambda
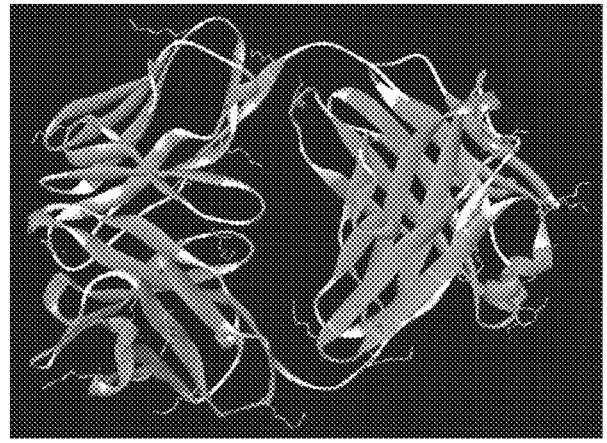
A  Fab-kappa

FIG. 6

```
hu Cγ
118
ASTKGPSVFP LAPSSKSTSG GTAALGCLVK DYFPEPVTVS WNSGALTSGV HTFPAVLQSS GLYSLSSVVT VPSSSLGTQT YICNVNHKPS NTKVDKKVEP
218
KSCDKTHTCP PCPAPELLGG PSVFLFPPKP KDTLMISRTP EVTCVVVDVS HEDPEVKFNW YVDGVEVHNA KTKPREEQYN STYRVVSVLT VLHQDWLNGK
318
EYKCKVSNKA LPAPIEKTIS KAKGQPREPQ VYTLPPSRDE LTKNQVSLTC LVKGFYPSDI AVEWESNGQP ENNYKTTPPV LDSDGSFFLY SKLTVDKSRW
418                                       447
QQGNVFSCSV MHEALHNHYT QKSLSLSPGK hu Cκ
108
RTVAAPSVFI FPPSDEQLKS GTASVVCLLN NFYPREAKVQ WKVDNALQSG NSQESVTEQD SKDSTYSLSS TLTLSKADYE KHKVYACEVT HQGLSSPVTK
208
SFNRGEC hu Cλ
110
GQPKAAPSVT LFPPSSEELQ ANKATLVCLI SDFYPGAVTV AWKADSSPVK AGVETTTPSK QSNNKYAASS YLSLTPEQWK SHKSYSCQVT HEGSTVEKTV
210
APTECS
```

FIG. 7

| CH1 | RFU | conjugation |
|---|---|---|
| A118K | 1482.697 | 0.0% |
| S119K | 2972.125 | 0.0% |
| T120K | 2162.525 | 43.2% |
| G122K | 2399.853 | 0.0% |
| S131K | 2489.956 | 0.0% |
| S132K | 2228.079 | 0.0% |
| S134K | 2510.796 | |
| T135K | 6392.472 | 80.4% |
| S136K | 10829.907 | 100.0% |
| G137K | 8619.62 | 38.9% |
| G138K | 1505.829 | 0.0% |
| T139K | 2209.782 | 23.4% |
| E152K | 1624.412 | 0.0% |
| P153K | 2304.666 | 0.0% |
| S160K | 2657.715 | 0.0% |
| A162K | 2984.247 | 0.0% |
| L163K | 2882.938 | 0.0% |
| T164K | 6262.873 | 0.0% |
| S165K | 1922.563 | 0.0% |
| G166K | 1870.622 | 0.0% |
| V167K | 1557.557 | 0.0% |
| S176K | 2501.47 | 0.0% |
| S177K | 1807.214 | 0.0% |
| G178K | 1964.895 | 0.0% |
| L179K | 1636.602 | 0.0% |
| P189K | 1599.761 | 0.0% |
| S190K | 1555.149 | 0.0% |
| S191K | | 0.0% |
| S192K | | 35.6% |
| L193K | | 84.8% |
| G194K | 1621.725 | 0.0% |
| T195K | 2260.968 | |
| Q196K | 1529.04 | 0.0% |
| T197K | 1537.084 | 0.0% |
| P206K | 1956.062 | 0.0% |
| S207K | 1486.97 | |

| Upper Hinge | RFU | conjugation |
|---|---|---|
| E216K | 1546.249 | 0.0% |
| P217K | 2532.893 | 0.0% |
| S219K | 2988.836 | 0.0% |
| D221K | 7438.612 | 87.6% |
| T223K | 7519.935 | 90.8% |
| H224K | 8863.961 | 71.6% |
| T225K | 4849.386 | 100.0% |

| Middle Hinge | RFU | conjugation |
|---|---|---|
| C226K | 2532.581 | 0.0% |
| P227K | 2354.525 | 0.0% |
| P228K | 2825.735 | 0.0% |
| C229K | 1765.406 | 0.0% |
| P230K | 2632.028 | 0.0% |

| Lower Hinge | RFU | conjugation |
|---|---|---|
| A231K | 2109.04 | 0.0% |
| P232K | 1742.478 | 0.0% |
| E233K | 1875.353 | 0.0% |
| L234K | 1815.527 | 0.0% |
| L235K | 2517.088 | 0.0% |

FIG. 7 (continued)

| | CH2 RFU | conjugation | | CH3 RFU | conjugation |
|---|---|---|---|---|---|
| G236K | 2236.25 | | G341K | 3075.741 | |
| G237K | 2304.169 | | Q342K | 3572.799 | |
| P247K | 3586.941 | | P343K | 5578.971 | 0.0% |
| M252K | 7153.469 | 75.1% | R344K | 2447.62 | |
| I253K | 1947.679 | | E345K | 1805.326 | |
| S254K | 2363.706 | | R355K | 2694.082 | |
| R255K | 1979.038 | | D356K | 2725.487 | |
| T256K | 1634.634 | | L358K | 2912.335 | |
| D265K | 3087.407 | | T359K | 3624.477 | |
| S267K | 1705.879 | | N361K | 2347.795 | |
| H268K | | | Q362K | 2385.153 | |
| E269K | 1557.406 | | S375K | 2205.751 | |
| D270K | 1667.335 | | D376K | 3507.073 | |
| P271K | 2086.99 | | E382K | 1826.903 | |
| E272K | 2473.559 | | N384K | 3079.738 | |
| D280K | 3097.36 | | G385K | 6249.705 | 0.0% |
| G281K | 3099.032 | | Q386K | 2659.827 | |
| V282K | 2597.079 | | P387K | 2416.05 | |
| E283K | 4393.219 | 0.0% | N389K | 3435.688 | |
| V284K | 2111.159 | | N390K | 2623.177 | |
| H285K | 3070.38 | | L398K | 1815.903 | |
| N286K | 2643.754 | | S400K | 1725.105 | |
| A287K | 6908.539 | 0.0% | D401K | 2674.659 | |
| T289K | 2614.413 | | G402K | 2595.023 | |
| Q295K | 3647.973 | | D413K | 2176.482 | |
| Y296K | 2717.136 | | S415K | 2302.063 | |
| N297K | 8611.262 | ND | R416K | 2438.814 | |
| S298K | 2440.299 | | Q418K | 2642.058 | |
| L309K | 1830.155 | | Q419K | 2225.251 | |
| H310K | 1755.229 | | G420K | 4998.647 | 0.0% |
| Q311K | 1882.229 | | N421K | 3497.052 | |
| D312K | 2683.16 | | V422K | 3775.808 | |
| L314K | | | A431K | 2736.367 | |
| N315K | | | H433K | 5569.945 | 0.0% |
| G316K | 1908.499 | | N434K | 3578.801 | |
| E318K | 2481.95 | | H435K | 2867.357 | |
| A327K | 2145.191 | | Y436K | 3213.522 | |
| P329K | 2561.945 | | S442K | 3629.279 | |
| A330K | 3577.203 | | L443K | 4658.861 | 0.0% |
| P331K | 2969.843 | | S444K | 5481.729 | 0.0% |
| S337K | 3239.634 | | P445K | 10513.805 | 79.5% |
| A339K | 3088.828 | | G446K | 3399.864 | |

FIG. 7 (continued)

| kappa | | conjugation | lambda | | conjugation |
|---|---|---|---|---|---|
| R108K | 1674.646 | | G110K | 1357.393 | |
| T109K | 1559.915 | | Q111K | 1363.309 | |
| V110K | 1880.975 | | P112K | 1626.973 | |
| A112K | 1427.546 | | A115K | 2027.041 | |
| D122K | 1271.206 | | S125K | 1843.345 | |
| E123K | 1195.854 | | E126K | 2251.417 | |
| S127K | 1468.245 | | L128K | 2674.771 | |
| G128K | 1827.766 | | Q129K | 2299.484 | |
| T129K | 1705.873 | | A130K | 1514.892 | |
| R142K | 1705.734 | | N131K | 1353.591 | |
| E143K | 1453.029 | | G145K | 1975.993 | |
| D151K | 3575.421 | 0.0% | A146K | 2082.148 | |
| N152K | 1380.271 | | V147K | 3431.846 | 0.0% |
| A153K | 1840.456 | | S155K | 2149.57 | |
| L154K | 1795.011 | | S156K | 2284.603 | |
| Q155K | 1422.783 | | P157K | 2165.887 | |
| S156K | 2061.606 | | A160K | 1493.712 | |
| G157K | 2648.713 | | G161K | 1482.482 | |
| E165K | 1591.482 | | S171K | 2192.156 | |
| D167K | 1523.247 | | N172K | 2115.781 | |
| S168K | 1385.903 | | N173K | 2544.968 | |
| D170K | 1215.408 | | T184K | 2422.712 | |
| S182K | 1377.625 | | E186K | 2421.28 | |
| A184K | 1471.194 | | Q187K | 3157.169 | 23.6% |
| E187K | 1400.015 | | S190K | 1886.288 | |
| H189K | 1452.142 | | H191K | 2053.506 | |
| V191K | 1788.624 | | E201K | 2055.553 | |
| Q199K | 1545.66 | | G202K | 1965.403 | |
| G200K | 2479.481 | | S203K | 1813.785 | |
| L201K | 4245.729 | 84.6% | P211K | 1984.017 | |
| S202K | 10192.973 | 100.0% | T212K | 1923.191 | |
| S203K | 1941.088 | | E213K | 3378.443 | 81.8% |
| P204K | 1579.605 | | S215K | 2159.499 | |
| N210K | 1883.766 | | | | |
| R211K | 1638.391 | | | | |
| G212K | 1775.578 | | | | |
| E213K | 3505.908 | 54.1% | | | |

```
            Controls
             RFU    conjugation
       M009  780.828     0.0%
       L448 12003.892  100.0%
```

Z-Gln-Gly-CAD-biotin: +631Da

| | LC | | | | Fd | | | | Fc | | | |
|---|---|---|---|---|---|---|---|---|---|---|---|---|
| | Calculated | Observed | dMass | percent | Calculated | Observed | dMass | percent | Calculated | Observed | dMass | percent |
| T135K-CH1 | 23216 | 23216 | 0 | 100.0% | 25099 | 25099 | 0 | 0.0% | 25200 | 25203 | 2 | 70.4% |
| | 23216 | | | 0.0% | 25099 | 25731 | 632 | 100.0% | 25363 | 25361 | -2 | 29.6% |
| S136K-CH1 | 23216 | 23217 | 1 | 100.0% | 25113 | 25113 | 0 | 16.2% | 25200 | 25202 | 2 | 72.8% |
| | 23216 | | | 0.0% | 25113 | 25745 | 632 | 83.8% | 25363 | 25362 | -1 | 27.2% |
| D221K-hg | 23216 | 23216 | 0 | 100.0% | 25085 | 25086 | 1 | 16.1% | 25200 | 25201 | 1 | 70.6% |
| | 23216 | | | 0.0% | 25085 | 25716 | 631 | 83.9% | 25363 | 25361 | -2 | 29.4% |
| T223K-hg | 23216 | 23217 | 1 | 100.0% | 25099 | 25100 | 1 | 57.4% | 25200 | 25202 | 2 | 73.2% |
| | 23216 | | | 0.0% | 25099 | 25731 | 632 | 42.6% | 25363 | 25361 | -2 | 26.8% |
| H224K-hg | 23216 | 23216 | 0 | 100.0% | 25063 | 25064 | 1 | 43.6% | 25200 | 25202 | 2 | 69.0% |
| | 23216 | | | 0.0% | 25063 | 25695 | 632 | 56.4% | 25363 | 25363 | -1 | 31.0% |
| T225K-hg | 23216 | 23215 | -1 | 100.0% | 25099 | 25099 | 0 | 70.0% | 25200 | 25200 | 0 | 72.2% |
| | 23216 | | | 0.0% | 25099 | 25729 | 630 | 30.0% | 25363 | 25362 | -1 | 27.8% |
| M252K-CH2 | 23216 | 23216 | 0 | 100.0% | 25072 | 25071 | -1 | 100.0% | 23752 | 23753 | 1 | 1.7% |
| | 23216 | | | 0.0% | 25072 | | | 0.0% | 23752 | 24384 | 632 | 98.3% |
| N297K-HC2 | 23216 | 23217 | 1 | 100.0% | 25072 | 25071 | -1 | 100.0% | 23769 | | | |
| | 23216 | | | 0.0% | 25072 | | | 0.0% | 23769 | | | |
| P443K-CH3 | 23216 | 23217 | 1 | 100.0% | 25072 | 25071 | -1 | 100.0% | 23786 | | | 0.0% |
| | 23216 | | | 0.0% | 25072 | | | 0.0% | 23786 | 24418 | 632 | 100.0% |
| L201K-Ck | 23231 | 23229 | -2 | 18.0% | 25072 | 25072 | 0 | 100.0% | 25200 | 25201 | 1 | 64.2% |
| | 23231 | 23864 | 633 | 82.0% | 25072 | | | 0.0% | 25363 | 25361 | -2 | 35.8% |
| S202K-Ck | 23257 | 23258 | 1 | 12.3% | 25072 | 25071 | -1 | 100.0% | 25200 | 25201 | 1 | 72.2% |
| | 23257 | 23890 | 633 | 87.7% | 25072 | | | 0.0% | 25363 | 25362 | -1 | 27.8% |

| | % conjugation |
|---|---|
| T135K-CH1 | 100.0% |
| S136K-CH1 | 83.8% |
| D221K-hg | 83.9% |
| T223K-hg | 42.6% |
| H224K-hg | 56.4% |
| T225K-hg | 30.0% |
| M252K-CH2 | 98.3% |
| N297K-HC2 | ND |
| P443K-CH3 | 100.0% |
| L201K-Ck | 82.0% |
| S202K-Ck | 87.7% |

FIG. 9

| | Z-Gln-Gly-N₃ | | | | Z-Gln-Gly-PEG₄-BCN | | | | Z-Gln-Gly-PEG₄-AuF | | | |
|---|---|---|---|---|---|---|---|---|---|---|---|---|
| | % HC conjugation | | % LC conjugation | Ave DAR | % HC conjugation | | % LC conjugation | Ave DAR | % HC conjugation | | % LC conjugation | Ave DAR |
| | DAR 1 | DAR 2 | DAR 1 | | DAR 1 | DAR 2 | DAR 1 | | DAR 1 | DAR 2 | DAR 1 | |
| T135KHC/A201KLC | 78.8% | 0.0% | 100.0% | 3.57 | ND | ND | 0.0% | 0.91* | 38.6% | 0.0% | 94.5% | 2.06183 |
| T135KHC/S202KLC | 74.9% | 0.0% | 70.3% | 2.90 | 41.9% | 0.0% | 0.0% | 0.84 | 38.4% | 0.0% | 44.6% | 1.65927 |
| T135K/L448HC | 41.8% | 56.7% | 0.0% | 3.10 | ND | ND | 0.0% | ND | 57.1% | 24.7% | 0.0% | 2.12049 |
| T135K/L448HC/L201KLC | 33.2% | 59.3% | 100.0% | 5.04 | ND | ND | 0.0% | 0.80* | 61.2% | 13.4% | 90.8% | 3.57403 |
| T135K/L448HC/S202KLC | 59.8% | 53.2% | 75.1% | 4.43 | 42.2% | 19.9% | 0.0% | 1.64 | 0.5% | 0.0% | 34.1% | 1.73509 |

FIG. 10

```
                      X                                                                                                        X
hu IgG1    GGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKT
hu IgG2    AGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKT
hu IgG3    GGPSVFLFPPKPKDTLMISRTPEVTCVVVDVSHEDPEVQFKWYVDGVEVHNAKTKPREEQYNSTFRVVSVLTVLHQDWLNGKEYKCKVSNKALPAPIEKT
hu IgG4    GGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKT hu IgG1    ISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNH
hu IgG2    ISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNH
hu IgG3    ISKTKGQPREPQVYTLPPSREEMTKNQVSLTCLVKGFYPSDIAVEWESSGQPENNYNTTPPMLDSDGSFFLYSKLTVDKSRWQQGNIFSCSVMHEALHNH
hu IgG4    ISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNH

X
hu IgG1    YTQKSLSLSPGK
hu IgG2    YTQKSLSLSPGK
hu IgG3    FTQKSLSLSPGK
hu IgG4    YTQKSLSLSLGK
```

FIG. 12
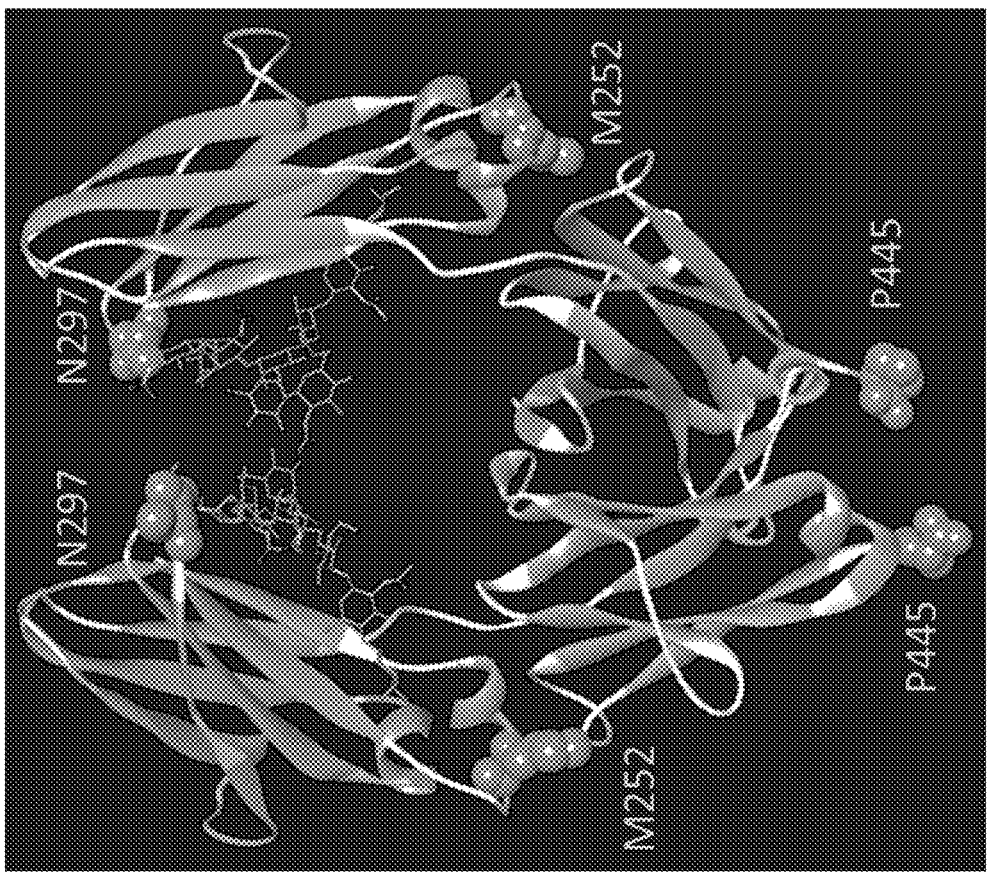
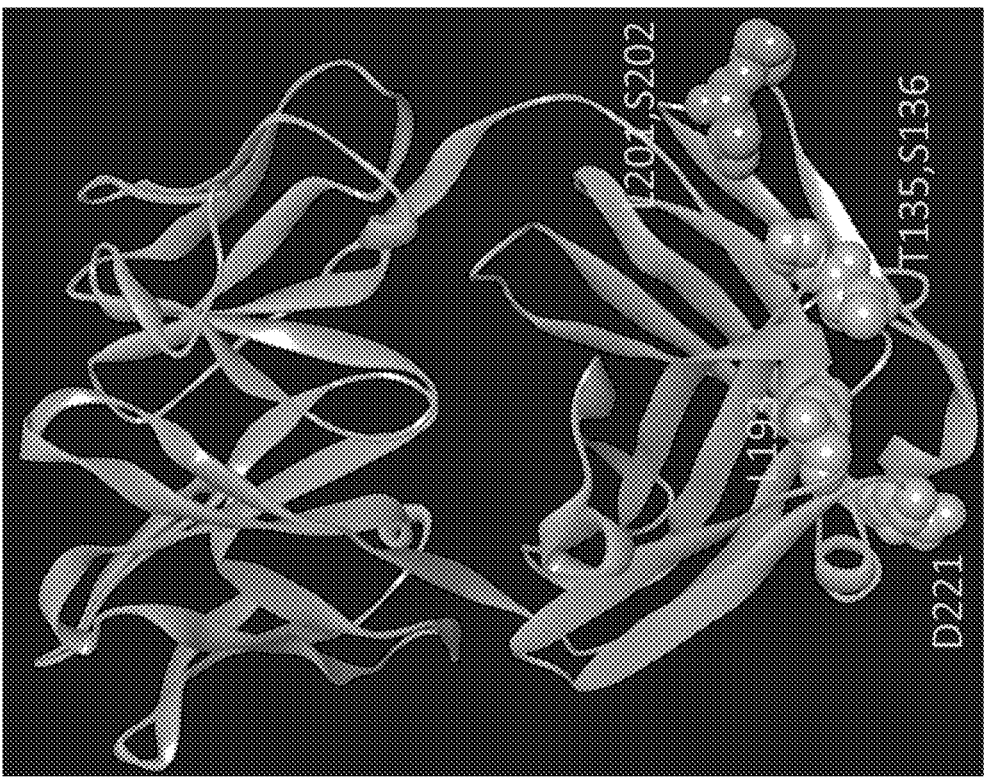

LYSINE CONJUGATED IMMUNOGLOBULINS

RELATED APPLICATIONS

This application is a continuation application of International Application PCT/JP2017/021672, filed on Jun. 12, 2017, which claims priority to U.S. Provisional Patent Application No. 62/348,410, filed on Jun. 10, 2016. The entire contents of each of the foregoing applications are incorporated herein by reference.

SEQUENCE LISTING

The instant application contains a Sequence Listing which has been submitted in ASCII format via EFS-Web and is hereby incorporated by reference in its entirety. Said ASCII copy, created on Oct. 30, 2017, is named 118557-03902_Sequence_Listing.txt and is 638,976 bytes in size.

TECHNICAL FIELD

Provided herein are lysine conjugated immunoglobulins and methods of creating the same.

BACKGROUND

The utility of monoclonal antibodies extends from basic research to therapeutic and diagnostic applications. The ability to conjugate antibodies to functional agents extends their functionality even further. The manufacture of conjugated antibodies usually involves conjugation of a linker, drug, or other functional agent to reactive lysine cysteine residues on the heavy (HC) and light (LC) chains of a monoclonal antibody (mAb). See Deonarain, et al., "Emerging formats for next-generation antibody drug conjugates", Expert Opinion in Drug Discovery (2015), 10(5): 463-481. Lysine conjugation is typically mediated by succinimide (NHS)-based or isothiocyanate-based chemistry. Cysteine-based conjugation requires partial reduction of the antibody to break some of the interchain disulfide bonds, thereby creating free thiol side chains. Thiol-reactive functional agents can then react with the free thiol groups on the antibody to generate antibody-drug conjugates (ADCs). Both of these methods result in modification of multiple lysines or cysteines leading to heterogeneous mixtures of ADCs with a distribution of drug-to-antibody (DAR) ratios and drug modifications at random positions.

A recent push to utilize site-specific conjugation technologies as a way to produce a homogeneous ADC product with a defined DAR has yielded several methods including engineering unpaired cysteines, incorporation of non-natural amino acids, and site-specific enzymatic modification. While these methods produce homogeneous products, they each have their disadvantages. Cysteine-based conjugation requires an added step to remove a capping cysteine, glutathione, or even a light chain from the unpaired cysteine. See, e.g., Junutula, et al., "Site-Specific Conjugation of a Cytotoxic Drug to an Antibody Improves Therapeutic Index", Nature Biotechnology, (2008) 26:925-932; Chen, et al., "Charge-based Analysis of Antibodies with Engineered Cysteines", MAbs (2009) 1(6): 563-571; Gomez, et al., "Effect of temperature, pH, dissolved oxygen, and hydrolysate on the formation of triple light chain antibodies in cell culture" Biotechnol Progress (2010), 26: 1438-1445. Further, serum instability of maleimide-based chemistry currently used for cysteine-based conjugates has been demonstrated raising concerns for loss in potency or off-target toxicity. Alley, et al., "Contribution of Linker Stability to the Activities of Anticancer Immunoconjugates", Bioconjugate Chemistry (2008) 19(3): 759-765; Shen, et al., "Conjugation site modulates the in vivo stability and therapeutic activity of antibody-drug conjugates", Nature Biotechnology (2012) 30: 184-189. Incorporation of non-natural amino acids requires expression in either a genetically modified cell-based or cell-free system. Hallam, et al., "Unnatural Amino Acids in Novel Antibody Conjugates", Future Med. Chem. (2014) 6(11): 1309-1324. Further, the presence of an unnatural amino acid could trigger an immunogenic response in patients. Site-specific enzymatic modifications, however, could potentially utilize a native, wild-type amino acid in the antibody sequence, thereby minimizing the chance for immunogenicity. Further, the post-translational bonds typically formed by protein-modifying enzymes are very stable.

Site-specific enzymatic modification of proteins has been explored using a family of proteins called transglutaminases that catalyze the formation of a stable isopeptide bond between the γ-carboxyamide group (acyl donor) of a glutamine and the ε-amino group (acyl acceptor) of a lysine (see FIG. 1) (see, e.g., Yokoyama, et al., "Properties and Applications of Microbial Transglutaminase", Appl. Microbiol. Biotech. (2004) 64: 47-454; Strop, "Versatility of Microbial Transglutaminase", Bioconjugate Chemistry, (2014) 25(5): 855-862; Kieliszek et al., "Microbial Transglutaminase and its Application in the Food Industry", Folia Microbiol (2014) 59:241-250). Recently, several groups have explored utilizing transglutaminase as a means to produce ADCs (see, e.g., Josten et al., "Use of Microbial Transglutaminase for the Enzymatic Biotinylation of Antibodies", J Immunol Methods, (2000) 240:47-54; Mindt et al., "Modification of Different IgG1 Antibodies via Glutamine and Lysine Using Bacterial and Human Tissue Transglutaminase", Bioconjugate Chemistry (2008) 19(1): 271-278); Jeger, et al., "Site-specific and stoichiometric modification of antibodies by bacterial transglutaminase" Angew. Chem. Int. Ed. Engl. (2010) 49: 9995-9997; Strop et al., "Location Matters: Site of Conjugation Modulates Stability and Pharmacokinetics of Antibody Drug Conjugates", Chem Biol (2013) 20(2):161-167; Dennler et al., "Transglutaminase-Based Chemo-Enzymatic Conjugation Approach Yields Homogeneous Antibody—Drug Conjugates", Bioconjugate Chemistry (2014) 25(3): 569-578; Siegmund, et al., "Locked by Design: A Conformationally Constrained Transglutaminase Tag Enables Efficient Site-Specific Conjugation", Angew. Chem. Int. Ed. Engl. (2015) 54(45):13420-13424). Transglutaminases are found in organisms ranging from bacteria through humans that are structurally and functionally related, yet each is involved in specific cellular processes. A microbial transglutaminase (microbial transglutaminase) isolated from the bacterium *Streptomyces mobaraensis* has been used extensively throughout the food industry to crosslink proteins together for various applications. Besides its low manufacturing cost, it is an attractive conjugation technique due to its ability to function under a wide range of pH, salt, and temperature conditions.

Despite over two decades of research, the substrate specificity of microbial transglutaminase has not been clearly defined. In general, glutamines or lysines on exposed loops with hydrophobic or positively charged adjacent residues tend to be preferred. See, Taguchi et al., "Substrate specificity analysis of microbial transglutaminase using proteinaceous protease inhibitors as natural model substrates", J. Biochem. (2000) 128:415-425; Sugimura et al., "Identification of preferred substrate sequences of microbial transglutaminase from *Streptomyces mobaraensis* using a phage-displayed peptide library", Arch. Biochem. Biophys. (2008) 477:379-383; Tagami et al., "Substrate specificity of microbial transglutaminase as revealed by three-dimensional docking simulation and mutagenesis", Protein Eng. Des. Sel. (2009) 22:747-752. The context of the acyl donor glutamine has been found to be more critical than the acyl acceptor lysine. See, e.g., Ohtsuka et al., "Substrate specificities of microbial transglutaminase for primary amines", J. Agric. Food Chem. (2000) 48: 6230-6233; Ohtsuka et al., "Comparison of substrate specificities of transglutaminases using synthetic peptides as acyl donors", Biosci. Biotechnol. Biochem. (2000) 64: 2608-2613; Gundersen et al., "Microbial transglutaminase displays broad acyl-acceptor substrate specificity", Appl. Microbiol. Biotechnol. (2013) 98:219-230. Indeed, a minimal acyl donor substrate requires an N-terminal N-carboxybenzyloxl (CBZ) group followed by a glutamine and a C-terminal glycine (CBZ-L-glutaminylglycine or Z-Gln-Gly) while the minimal acyl acceptor is ammonia.

Due to a lower specificity for the acyl acceptor amine by microbial transglutaminase, research thus far has been focused mainly on transamidation of antibody glutamine residues. See, Josten et al., Mindt et al., Jeger et al., Strop et al., Dennler et al., and Siegmund et al., referenced above. Contrary to an earlier report (Josten et al. 2000) describing mTGase-mediated biotinylation of an antibody using acyl acceptor substrates, several groups recently showed little or no mTGase modification of wild-type antibodies by the same or similar substrates. These data confirmed that despite the abundance of solvent-exposed glutamines, none were in the proper context to be transamidated by mTGase (Mindt et al. 2008; Jeger et al. 2010; Strop et al. 2013).

It has also been speculated that utilizing an amine donor-based substrate to transamidate a lysine may yield a heterogeneous ADC product due to multiple reactive lysines on the surface of an IgG (Josten et al. 2000; Jeger et al. 2010). Human IgG is comprised of an average of 80 lysines, of which 80-90% are predicted to be solvent exposed (Gautier et al., "Lysine Conjugated Properties in Human IgGs Studied by Integrating High-Resolution Native Mass Spectrometry and Bottom-Up Proteomics", Proteomics (2015) 15(16):2756-2765; data not shown), and the C-terminal codon of $IgG_1$, $IgG_2$, $IgG_3$, and $IgG_4$ is a lysine (Ellison et al., DNA (1981) 1:11-18; Ellison et al. ("Ellison et al. 2"), Proc. Nat. Acad. Sci. USA, (1982) 79:1984-1988; Ellison et al., Nucleic Acid Res. (1982) 10:4071-4079). However, serum-derived IgG lacks the lysine (Wang et al., J. Immunol. (1980) 125:1048-1054; Edelman et al., Proc Natl Acad. Sci. USA (1969) 63:78-85; Frangione et al., Biochemistry (1980) 19:4304-4308; Pink et al., Biochem. J. (1970) 117:33-47). The same has been observed for IgD (White et al., Science (1985) 228:733-737; Lin et al., Proc. Natl. Acad. Sci. USA, (1981) 78:504-508; Shinoda et al., Proc. Natl. Acad. Sci. USA (1981) 78:785-789). Recombinant expression of IgG1 in HEK293 and CHO cells also results in a protein lacking the C-terminal Lys447 (Ellison et al.; Harris et al., Eur. J. Biochem. (1990) 194:611-620; Harris, J. Chromatogr. A (1995) 705:129-134; Dick et al., Biotechnol. Bioeng. (2008) 100:1132-1143).

To date, those of ordinary skill in the art thought that utilizing an amine donor-based substrate to transamidate a lysine may yield a heterogeneous ADC product due to the plethora of reactive lysines on the surface of an IgG (Josten et al. and Jeger et al.) and, thus, use of an amine donor-based substrate to transamidate lysine residues on immunoglobulins has been discouraged.

Thus, there exists a need for site-specific enzymatic modifications of immunoglobulins to create conjugates which have a predictable rate of conjugation. This will allow for creation of ADCs with a relatively homologous DAR.

SUMMARY

The instant invention surprisingly discloses that, while no modification of wild-type immunoglobulin lysines by microbial transglutaminase was observed, when an engineered lysine residue was introduced into the immunoglobulin, or antigen-binding portion thereof, microbial transglutaminase was able to utilize the engineered lysine residue as an acyl acceptor. Surprisingly, conjugation of the engineered lysine residue using microbial transglutaminase leads to site-specific and predictable incorporation of conjugated functional agents. Moreover, engineering lysine residues into the constant region has a wide applicability to any immunoglobulin, or antigen-binding portion thereof, regardless of its variable regions and binding specificity.

In one aspect, disclosed herein is a method for generating a conjugated immunoglobulin, the method comprising contacting an immunoglobulin, or antigen-binding portion thereof, with a microbial transglutaminase and a functional agent comprising an acyl donor substrate and wherein the immunoglobulin, or antigen-binding portion thereof, comprises an engineered lysine residue, wherein the engineered lysine residue is a lysine residue insertion or a natural amino acid residue which has been mutated to a lysine residue, wherein the acyl donor substrate comprises a glutamine residue, and wherein the functional agent is a therapeutic agent or a diagnostic agent, wherein the microbial transglutaminase conjugates the engineered lysine residue of the immunoglobulin, or antigen-binding portion thereof, to the glutamine residue of the acyl donor substrate on the functional agent, thereby generating the conjugated immunoglobulin.

In another aspect, disclosed herein is a method for generating a conjugated immunoglobulin, the method comprising i) contacting an immunoglobulin, or antigen-binding portion thereof, with a microbial transglutaminase and an acyl donor substrate, wherein the immunoglobulin, or antigen-binding portion thereof, comprises an engineered lysine residue and wherein the engineered lysine residue is a lysine residue insertion or a natural amino acid residue which has been mutated to a lysine residue, and wherein the acyl donor substrate comprises a glutamine residue and a reactive group, wherein the microbial transglutaminase conjugates the engineered lysine residue of the immunoglobulin, or antigen-binding portion thereof, to the glutamine residue of the acyl donor substrate, and ii) conjugating a functional agent to the reactive group of the acyl donor substrate, wherein the functional agent is a therapeutic agent or a diagnostic agent, thereby generating the conjugated immunoglobulin. In one embodiment, the engineered lysine residue is present in a heavy chain. In one embodiment, the engineered lysine residue is present in a heavy chain constant region. In one embodiment, the engineered lysine residue is present in a light chain. In another embodiment, the the engineered lysine residue is present in a light chain constant region. In one embodiment, the engineered lysine residue is present in a kappa light chain chain. In one embodiment, the engineered lysine residue is present in a kappa light chain constant region. In one embodiment, the engineered lysine residue is present in a lambda light chain. In one embodiment, the engineered lysine residue is present in a lambda light chain constant region. In one embodiment, the engineered lysine residue is present in a variable region. In one embodiment, the engineered lysine residue is not present in a variable region.

In one embodiment, the reactive group of the acyl donor substrate is conjugated to the functional agent by click chemistry.

In one embodiment, the natural amino acid residue which has been mutated to a lysine residue is selected from the group consisting of: Threonine 135 (T135K), Serine 136 (S136K), Leucine 193 (L193K), Aspartic acid 221 (D221K), Threonine 223 (T223K), Histidine 224 (H224K), Threonine 225 (T225K), Methionine 252 (M252K), Asparagine 297 (N297K), or Proline 445 (P445K) on a heavy chain of the immunoglobulin, or antigen-binding portion thereof, Leucine 201 (L201K) or Serine 202 (S202K) on a kappa light chain of the immunoglobulin, or antigen-binding portion thereof, or Glutamic acid 213 (E213K) on a lambda light chain of the immunoglobulin, or antigen-binding portion thereof. In one embodiment, the heavy chain (before mutation) comprises an amino acid sequence set forth as SEQ ID NO:18. In another embodiment, the kappa light chain (before mutation) comprises an amino acid sequence set forth as SEQ ID NO:19. In another embodiment, the lambda light chain (before mutation) comprises a sequence set forth as SEQ ID NO:20.

In one embodiment, the heavy chain further comprises an amino acid residue which has been added to its C-terminus at position 448, and wherein said amino acid residue is not proline or an acidic amino acid residue. In a further embodiment, the amino acid residue which has been added to the C-terminus at position 448 is leucine.

In one embodiment, the lysine residue insertion is a lysine residue which has been inserted between Serine 191 and Serine 192 or between Serine 192 and Leucine 193 on a heavy chain of the immunoglobulin, or antigen-binding portion thereof.

In one embodiment, the immunoglobulin is a fragment-antigen binding (Fab'), and wherein the natural amino acid residue which has been mutated to a lysine residue is selected from the group consisting of: Aspartic acid 221 (D221K), Threonine 223 (T223K), Histidine 224 (H224K), Threonine 225 (T225K), Proline 228 (P228K), Proline 230 (P230K), and Glutamic acid 233 (E233K) on a heavy chain of the immunoglobulin, or antigen-binding portion thereof. In another embodiment, the Fab' comprises the entire hinge region. In another embodiment, the Fab' comprises a truncated hinge region.

In one embodiment, the immunoglobulin, or antigen-binding portion thereof, further comprises a second engineered lysine residue, wherein the second engineered lysine residue is a second lysine residue insertion or a second natural amino acid residue which has been mutated to a lysine residue, and wherein the microbial transglutaminase conjugates the second engineered lysine residue of the immunoglobulin, or antigen-binding portion thereof, to the glutamine residue of the acyl donor substrate. In another embodiment, the natural amino acid residue which has been mutated to the engineered lysine residue is Serine 136 (S136K) on a heavy chain of the immunoglobulin, or antigen-binding portion thereof, and the second natural amino acid residue which has been mutated to the second engineered lysine residue is Serine 202 (S202K) on a kappa light chain of the immunoglobulin, or antigen-binding portion thereof. In another embodiment, the natural amino acid residue which has been mutated to the engineered lysine residue is Threonine 135 (T135K) on a heavy chain of the immunoglobulin, or antigen-binding portion thereof, and the second natural amino acid residue which has been mutated to the second engineered lysine residue is Leucine 201 (L201K) on a kappa light chain of the immunoglobulin, or antigen-binding portion thereof. In yet another embodiment, the natural amino acid residue which has been mutated to the engineered lysine residue is Threonine 135 (T135K) on a heavy chain of the immunoglobulin, or antigen-binding portion thereof, and the second natural amino acid residue which has been mutated to the second engineered lysine residue is Serine 202 (S202K) on a kappa light chain of the immunoglobulin, or antigen-binding portion thereof. In a further embodiment, the heavy chain further comprises an amino acid residue which has been added to its C-terminus at position 448, and wherein said amino acid residue is not proline or an acidic amino acid residue. In one further aspect, the amino acid residue which has been added to the C-terminus at position 448 is leucine.

In one embodiment, the immunoglobulin further comprises a third engineered lysine residue, wherein the third engineered lysine residue is a third lysine residue insertion or a third natural amino acid residue which has been mutated to a lysine residue, and wherein the microbial transglutaminase conjugates the third engineered lysine residue of the immunoglobulin, or antigen-binding portion thereof, to the glutamine residue of the acyl donor substrate. In one embodiment, the first natural amino acid residue which has been mutated to the engineered lysine residue is Serine 136 (S136K) on a heavy chain of the immunoglobulin, or antigen-binding portion thereof, the second natural amino acid residue which has been mutated to the second engineered lysine residue is Asparagine 297 (N297K) on a heavy chain of the immunoglobulin, or antigen-binding portion thereof, and the third natural amino acid residue which has been mutated to the third engineered lysine residue is Serine 202 (S202K) on a kappa light chain of the immunoglobulin, or antigen-binding portion thereof.

In one embodiment, the immunoglobulin, or antigen-binding portion thereof, further comprises a fourth engineered lysine residue, wherein the fourth engineered lysine residue is a fourth lysine residue insertion or a fourth natural amino acid residue which has been mutated to a lysine residue, and wherein the microbial transglutaminase conjugates the fourth engineered lysine residue of the immunoglobulin, or antigen-binding portion thereof, to the glutamine residue of the acyl donor substrate. In another embodiment, the first natural amino acid residue which has been mutated to the engineered lysine residue is Serine 136 (S136K) on a heavy chain of the immunoglobulin, or antigen-binding portion thereof, the second natural amino acid residue which has been mutated to the second engineered lysine residue is Asparagine 297 (N297K) on a heavy chain of the immunoglobulin, or antigen-binding portion thereof, the third natural amino acid residue which has been mutated to the third engineered lysine residue is Serine 202 (S202K) on a kappa light chain of the immunoglobulin, or antigen-binding portion thereof, and the fourth natural amino acid residue which has been mutated to a fourth engineered lysine residue is Proline 445 (P445K) on a heavy chain of the immunoglobulin, or antigen-binding portion thereof.

In one embodiment, the amino acid residue after the engineered lysine residue is not proline or an acidic amino acid residue. In another embodiment, the amino acid residue before the engineered lysine residue is not an acidic amino acid residue. In another embodiment, mutating the amino acid residue after the engineered lysine residue to any amino acid other than proline or an acidic amino acid residue and mutating the amino acid residue before the engineered lysine residue to any amino acid other than an acidic amino acid residue, provide the optimal sequence for an engineered acyl acceptor lysine site.

In one embodiment, the amino acid residue before the engineered lysine residue is a non-acidic amino acid residue insertion, or a natural acidic amino acid residue which has been mutated to a non-acidic amino acid residue. In one embodiment, the amino acid residue after the engineered lysine residue is an amino acid residue insertion, wherein the amino acid residue insertion is a non-acidic amino acid residue insertion and a non-proline residue insertion, or a natural acidic amino acid residue or a natural proline residue, which has been mutated to a non-acidic amino acid residue and a non-proline residue. In one embodiment, the non-acidic amino acid residue is lysine, arginine, histidine, serine, threonine, asparagine, glutamine, cysteine, glycine, proline, alanine, valine, isoleucine, leucine, methionine, phenylalanine, tyrosine, or tryptophan. In one embodiment, the non-acidic amino acid residue insertion is an lysine, arginine, histidine, serine, threonine, asparagine, glutamine, cysteine, glycine, proline, alanine, valine, isoleucine, leucine, methionine, phenylalanine, tyrosine, or tryptophan insertion. In one embodiment, the non-acidic amino acid and non-proline residue is lysine, arginine, histidine, serine, threonine, asparagine, glutamine, cysteine, glycine, alanine, valine, isoleucine, leucine, methionine, phenylalanine, tyrosine, or tryptophan. In one embodiment, the natural acidic amino acid residue is aspartic acid or glutamic acid.

In one embodiment, the immunoglobulin, or antigen-binding portion thereof, comprises a heavy chain which further comprises at least one amino acid residue which has been added to its C-terminus at position 448, and wherein said at least one amino acid residue is not proline or an acidic amino acid residue. In a further embodiment, the at least one amino acid residue which has been added to the C-terminus at position 448 is leucine.

In one embodiment, the immunoglobulin, or antigen-binding portion thereof, comprises a light chain which comprises an insertion of one to four additional amino acids after cysteine 214, wherein the lysine residue insertion is a lysine residue which has been inserted after the one to four additional amino acids, and wherein a leucine residue has been inserted after the lysine residue. In a further embodiment, the insertion of one to four additional amino acids after cysteine 214, the lysine residue which has been inserted after the one to four additional amino acids, and the leucine residue which has been inserted after the lysine residue comprises a sequence selected from the group consisting of: GKL, GGKL (SEQ ID NO: 285), GGSKL (SEQ ID NO: 286), and GGSGKL (SEQ ID NO: 287). In one embodiment, the immunoglobulin, or antigen-binding portion thereof, comprises a light chain which comprises an insertion of the sequence GGSGKL (SEQ ID NO: 285) after cysteine 214.

In one embodiment, the functional agent comprising the acyl donor substrate is according to one Formulae (I) or (II):

   (I)

   (II)

wherein Z is a carboxylbenzyloxy (CBZ) group or an amino acid residue; Gln is a glutamine amino acid residue; each L is independently a straight or branched linker from 1 to 20 carbon atoms, wherein one or more of the carbon atoms may be optionally and independently replaced with a nitrogen, oxygen or sulfur atom, and wherein each carbon and nitrogen atom may be optionally substituted; or each L is optionally and independently an amino acid residue; m is an integer from 0 to 5; n is an integer from 0 to 5; and Y is a functional agent.

In one embodiment, the functional agent comprising the acyl donor substrate is according to formula (I), and wherein Z is a CBZ group; wherein L is a polyethylene glycol moiety (PEG) (—O((CH$_2$)$_2$)—), ethyl amine (—NH((CH$_2$)$_2$)—) or propyl amine (—NH((CH$_2$)$_3$)—); and wherein n is 0, 1, 2 or 3. In one embodiment, L is a polyethylene glycol moiety (PEG). In another embodiment, L comprises one or more amino acids and a polyethylene glycol moiety (PEG). In another embodiment, the functional agent comprising the acyl donor substrate is according to formula (I), wherein Z is a CBZ group, and wherein L is an amino acid. In one embodiment, L is Gly; m is 1; and n is 1. In another embodiment, the functional agent comprising the acyl donor substrate is according to formula (II), wherein Z is a CBZ group; m is 1; n is 2, 3 or 4; and at least one L is Gly; and at least one L is a PEG moiety. In a further embodiment, the functional agent comprising the acyl donor substrate is according to formula (II), wherein Z is a CBZ group; m is 1; n is 4; one L is Gly and the remaining three L groups are each PEG moieties. In another embodiment, the functional agent Y is auristatin F.

In one embodiment, the acyl donor substrate is according to one Formulae (III) or (IV):

   (III)

   (IV)

wherein Z is a carboxylbenzyloxy (CBZ) group or an amino acid residue; Gln is a glutamine amino acid residue; each L is independently a straight or branched linker from 1 to 20 carbon atoms, wherein one or more of the carbon atoms may be optionally and independently replaced with a nitrogen, oxygen or sulfur atom, and wherein each carbon and nitrogen atom may be optionally substituted; or each L is optionally and independently an amino acid residue; m is an integer from 0 to 5; n is an integer from 0 to 5; and X is a reactive group.

In one embodiment, L is a polyethylene glycol moiety (PEG). In another embodiment, when n is 2-5, at least one L comprises one or more amino acids and another L is a polyethylene glycol (PEG) moiety. In one embodiment, the acyl donor substrate is according to formula (III), and wherein Z is a CBZ group; wherein L is a polyethylene glycol moiety (PEG) (—O((CH$_2$)$_2$)—), ethyl amine (—NH((CH$_2$)$_2$)—) or propyl amine (—NH((CH$_2$)$_3$)—); and wherein n is 0, 1, 2 or 3. In another embodiment, the acyl donor substrate is according to formula (III), wherein Z is a CBZ group, and wherein L is an amino acid. In one embodiment, L is Gly; n is 1; and m is 1. In another embodiment, the acyl donor substrate is according to formula (IV), wherein Z is a CBZ group; m is 1; n is 1, 2 or 3; and at least one L is Gly.

In another embodiment, X is a reactive group selected from the group consisting of (1R,8S,9s)-bicyclo[6.1.0]non-4-yn-9-ylmethanol (BCN),

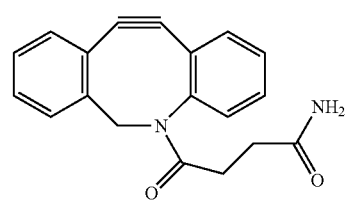

(dibenzocyclooctyne; DBCO), trans-cyclooctene (TCO), azido (N$_3$), alkyne, tetrazine methylcyclopropene, norbornene, hydrazide/hydrazine, and aldehyde.

In one embodiment, the therapeutic agent is an antibody or antigen-binding portion thereof, a chemotherapeutic agent, a drug agent, a radioactive agent, a cytotoxic agent, an antibiotic, a small molecule, a nucleic acid, or a polypeptide. In another embodiment, the diagnostic agent is a fluorophore, a fluorescent dye, a radionuclide, or an enzyme.

In one embodiment, the microbial transglutaminase is from *Streptomyces mobaraensis*.

In one embodiment, the immunoglobulin, or antigen-binding portion thereof is an IgG$_1$ immunoglobulin, or antigen-binding portion thereof. In another embodiment, the immunoglobulin, or antigen-binding portion thereof, is an IgG$_2$, IgG$_3$, or IgG$_4$ immunoglobulin, or antigen-binding portion thereof. In one embodiment, the immunoglobulin is an IgA$_1$, an IgA$_2$, or an IgM immunoglobulin. In one embodiment, the immunoglobulin, or antigen-binding portion thereof, is an IgD or IgE, immunoglobulin, or antigen-binding portion thereof.

In one embodiment, the immunoglobulin, or antigen-binding portion thereof, is a human immunoglobulin, or antigen-binding portion thereof or a humanized immunoglobulin, or antigen-binding portion thereof. In one embodiment, the immunoglobulin, or antigen-binding portion thereof, is a chimeric immunoglobulin or a non-human immunoglobulin, or antigen-binding portion thereof.

In one embodiment, the immunoglobulin, or antigen-binding portion thereof, comprises two heavy chains and two light chains. In one embodiment, there is no intramolecular cross-linking, i.e., no disulfide bond(s), between the two heavy chains of the immunoglobulin, or antigen-binding portion thereof.

In one embodiment, the ratio of functional agent to immunoglobulin, or antigen-binding portion thereof, is 1:1 to 200:1 or 1:1 to 100:1.

In another aspect, described herein is a conjugated immunoglobulin comprising an immunoglobulin, or antigen-binding portion thereof and a functional agent, wherein the immunoglobulin comprises an engineered lysine residue and wherein the engineered lysine residue is a lysine residue insertion or a natural amino acid residue which has been mutated to a lysine residue, the functional agent comprises an acyl donor substrate, wherein the acyl donor substrate comprises a glutamine residue, and the functional agent is a therapeutic agent or a diagnostic agent, wherein the engineered lysine residue of the immunoglobulin, or antigen-binding portion thereof, is conjugated to the glutamine residue of the acyl donor substrate of the functional agent. In one embodiment, the engineered lysine residue is present in a heavy chain. In one embodiment, the engineered lysine residue is present in a heavy chain constant region. In one embodiment, the engineered lysine residue is present in a light chain. In another embodiment, the the engineered lysine residue is present in a light chain constant region. In one embodiment, the engineered lysine residue is present in a kappa light chain chain. In one embodiment, the engineered lysine residue is present in a kappa light chain constant region. In one embodiment, the engineered lysine residue is present in a lambda light chain. In one embodiment, the engineered lysine residue is present in a lambda light chain constant region. In one embodiment, the engineered lysine residue is present in a variable region. In one embodiment, the engineered lysine residue is not present in a variable region.

In another aspect, described herein is a conjugated immunoglobulin comprising an immunoglobulin, or antigen-binding portion thereof and a functional agent, wherein the immunoglobulin, or antigen-binding portion thereof, comprises an engineered lysine residue and wherein the engineered lysine residue is a lysine residue insertion or a natural amino acid residue which has been mutated to a lysine residue, the engineered lysine residue is conjugated to a glutamine residue on an acyl donor substrate, wherein the acyl donor substrate further comprises a reactive group, the reactive group is conjugated to a functional agent, wherein the functional agent is a therapeutic agent or a diagnostic agent. In one embodiment, the engineered lysine residue is present in a heavy chain. In one embodiment, the engineered lysine residue is present in a heavy chain constant region. In one embodiment, the engineered lysine residue is present in a light chain. In another embodiment, the the engineered lysine residue is present in a light chain constant region. In one embodiment, the engineered lysine residue is present in a kappa light chain chain. In one embodiment, the engineered lysine residue is present in a kappa light chain constant region. In one embodiment, the engineered lysine residue is present in a lambda light chain. In one embodiment, the engineered lysine residue is present in a lambda light chain constant region. In one embodiment, the engineered lysine residue is present in a variable region. In one embodiment, the engineered lysine residue is not present in a variable region.

In one embodiment, the natural amino acid residue which has been mutated to a lysine residue is selected from the group consisting of: Threonine 135 (T135K), Serine 136 (S136K), Leucine 193 (L193K), Aspartic acid 221 (D221K), Threonine 223 (T223K), Histidine 224 (H224K), Threonine 225 (T225K), Methionine 252 (M252K), Asparagine 297 (N297K), or Proline 445 (P445K) on a heavy chain of the immunoglobulin, or antigen-binding portion thereof, Leucine 201 (L201K) or Serine 202 (S202K) on a kappa light chain of the immunoglobulin, or antigen-binding portion thereof, or Glutamic acid 213 (E213K) on a lambda light chain of the immunoglobulin, or antigen-binding portion thereof. In one embodiment, the heavy chain (before mutation) comprises an amino acid sequence of SEQ ID NO:18. In one embodiment, the kappa light chain (before mutation) comprises an amino acid sequence of SEQ ID NO:19. In one embodiment, the lambda light chain (before mutation) comprises an amino acid sequence of SEQ ID NO:20.

In one embodiment, the heavy chain further comprises an amino acid residue which has been added to its C-terminus at position 448, and wherein said amino acid residue is not proline or an acidic amino acid residue. In a further embodiment, the at least one amino acid residue which has been added to the C-terminus at position 448 is leucine.

In another embodiment, the immunoglobulin, or antigen-binding portion thereof, comprises a light chain which comprises at least one amino acid residue that has been added to the C-terminus after position 214, wherein the at least one amino acid residue is GGSGKL (glycine glycine serine glycine lysine leucine) (SEQ ID NO: 287). In another embodiment, the immunoglobulin, or antigen-binding portion thereof, comprises a light chain which further comprises at least one amino acid residue which has been added to the C-terminus after position 214, wherein the at least one amino acid residue is GGSGKL (SEQ ID NO: 287). In one embodiment, the immunoglobulin, or antigen-binding portion thereof, comprises a light chain which comprises an insertion of the sequence GGSGKL (SEQ ID NO: 287) after cysteine 214.

In one embodiment, the lysine residue insertion is a lysine residue which has been inserted between Serine 191 and Serine 192 or between Serine 192 and Leucine 193 on a heavy chain of the immunoglobulin, or antigen-binding portion thereof.

In one embodiment, the immunoglobulin, or antigen-binding portion thereof is a fragment-antigen binding (Fab), and wherein the natural amino acid residue which has been mutated to a lysine residue is selected from the group consisting of: Aspartic acid 221 (D221K), Threonine 223 (T223K), Histidine 224 (H224K), Threonine 225 (T225K), Proline 228 (P228K), Proline 230 (P230K), and Glutamic acid 233 (E233K) on a heavy chain of the immunoglobulin, or antigen-binding portion thereof. In another embodiment, the Fab comprises the entire hinge region. In another embodiment, the Fab comprises a truncated hinge region.

In one embodiment, the immunoglobulin, or antigen-binding portion thereof, further comprises a second natural amino acid residue which has been mutated to a second lysine residue, and wherein the microbial transglutaminase conjugates the second lysine residue of the immunoglobulin, or antigen-binding portion thereof, to the glutamine residue of the acyl donor substrate. In another embodiment, the first natural amino acid residue which has been mutated to the lysine residue is Serine 136 (S136K) on a heavy chain of the immunoglobulin, or antigen-binding portion thereof, and the second natural amino acid residue which has been mutated to the second lysine residue is Serine 202 (S202K). In another embodiment, the natural amino acid residue which has been mutated to the engineered lysine residue is Threonine 135 (T135K) on a heavy chain of the immunoglobulin, or antigen-binding portion thereof, and the second natural amino acid residue which has been mutated to the second engineered lysine residue is Leucine 201 (L201K) on a kappa light chain of the immunoglobulin, or antigen-binding portion thereof. In yet another embodiment, the natural amino acid residue which has been mutated to the engineered lysine residue is Threonine 135 (T135K) on a heavy chain of the immunoglobulin, or antigen-binding portion thereof, and the second natural amino acid residue which has been mutated to the second engineered lysine residue is Serine 202 (S202K) on a kappa light chain of the immunoglobulin, or antigen-binding portion thereof.

In a further embodiment, the heavy chain further comprises at least one amino acid residue which has been added to its C-terminus at position 448, and wherein the at least one amino acid residue is not proline or an acidic amino acid residue. In one embodiment, the at least one amino acid residue which has been added to the C-terminus at position 448 is leucine.

In one embodiment, the immunoglobulin further comprises a third natural amino acid residue which has been mutated to a third lysine residue, and wherein the microbial transglutaminase conjugates the third lysine residue of the immunoglobulin, or antigen-binding portion thereof, to the glutamine residue of the acyl donor substrate. In another embodiment, the first natural amino acid residue which has been mutated to the lysine residue is Serine 136 (S136K) on a heavy chain of the immunoglobulin, or antigen-binding portion thereof, the second natural amino acid residue which has been mutated to the second lysine residue is Asparagine 297 (N297K) on a heavy chain of the immunoglobulin, or antigen-binding portion thereof, and the third natural amino acid residue which has been mutated to the third lysine residue is Serine 202 (S202K) on a kappa light chain of the immunoglobulin, or antigen-binding portion thereof.

In one embodiment, the immunoglobulin, or antigen-binding portion thereof, further comprises a fourth natural amino acid residue which has been mutated to a fourth lysine residue, and wherein the microbial transglutaminase conjugates the fourth lysine residue of the immunoglobulin, or antigen-binding portion thereof, to the glutamine residue of the acyl donor substrate. In another embodiment, the first natural amino acid residue which has been mutated to the lysine residue is Serine 136 (S136K) on a heavy chain of the immunoglobulin, or antigen-binding portion thereof, the second natural amino acid residue which has been mutated to the second lysine residue is Asparagine 297 (N297K) on a heavy chain of the immunoglobulin, or antigen-binding portion thereof, the third natural amino acid residue which has been mutated to the third lysine residue is Serine 202 (S202K) on a kappa light chain of the immunoglobulin, or antigen-binding portion thereof, and the fourth natural amino acid residue which has been mutated to a fourth lysine residue is Proline 445 (P445K) on a heavy chain of the immunoglobulin, or antigen-binding portion thereof.

In one embodiment, the amino acid residue after the engineered lysine residue is not proline or an acidic amino acid residue. In another embodiment, the amino acid residue before the engineered lysine residue is not an acidic amino acid residue. In another embodiment, mutating the amino acid residue after the engineered lysine residue to any amino acid other than proline or an acidic amino acid residue and mutating the amino acid residue before the engineered lysine residue to any amino acid other than an acidic amino acid residue, provide the optimal sequence for an engineered acyl acceptor lysine site.

In one embodiment, the amino acid residue before the engineered lysine residue is a non-acidic amino acid residue insertion, or a natural acidic amino acid residue which has been mutated to a non-acidic amino acid residue. In one embodiment, the amino acid residue after the engineered lysine residue is an amino acid residue insertion, wherein the amino acid residue insertion is a non-acidic amino acid residue and a non-proline residue insertion, or a natural acidic amino acid residue or a natural proline residue, which has been mutated to a non-acidic amino acid residue and a non-proline residue. In a further embodiment, the non-acidic amino acid residue is lysine, arginine, histidine, serine, threonine, asparagine, glutamine, cysteine, glycine, proline, alanine, valine, isoleucine, leucine, methionine, phenylalanine, tyrosine, or tryptophan. In another further embodiment, the non-acidic amino acid residue insertion is an lysine, arginine, histidine, serine, threonine, asparagine, glutamine, cysteine, glycine, proline, alanine, valine, isoleucine, leucine, methionine, phenylalanine, tyrosine, or tryptophan insertion. In yet another further embodiment, the non-acidic amino acid and non-proline residue is lysine, arginine, histidine, serine, threonine, asparagine, glutamine, cysteine, glycine, alanine, valine, isoleucine, leucine, methionine, phenylalanine, tyrosine, or tryptophan. In yet another further embodiment, the natural acidic amino acid residue is aspartic acid or glutamic acid.

In one embodiment, the immunoglobulin, or antigen-binding portion thereof, comprises a heavy chain which further comprises at least one amino acid residue which has been added to its C-terminus at position 448, and wherein the at least one amino acid residue is not proline or an acidic amino acid residue. In a further embodiment, the at least one amino acid residue which has been added to the C-terminus at position 448 is leucine.

In one embodiment, the immunoglobulin, or antigen-binding portion thereof, comprises a light chain which comprises an insertion of one to four additional amino acids after cysteine 214, wherein the lysine residue insertion is a lysine residue which has been inserted after the one to four additional amino acids, and wherein a leucine residue has been inserted after the lysine residue. In a further embodiment, the insertion of one to four additional amino acids after cysteine 214, the lysine residue which has been inserted after the one to four additional amino acids, and the leucine residue which has been inserted after the lysine residue comprise a sequence selected from the group consisting of: GKL, GGKL (SEQ ID NO: 285), GGSKL (SEQ ID NO: 286), and GGSGKL (SEQ ID NO: 287).

In one embodiment, the functional agent comprising the acyl donor substrate is according to one Formulae (I) or (II):

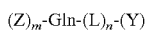

(I)

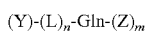

(II)

wherein Z is a carboxylbenzyloxy (CBZ) group or an amino acid residue; Gln is a glutamine amino acid residue; each L is independently a straight or branched linker from 1 to 20 carbon atoms, wherein one or more of the carbon atoms may be optionally and independently replaced with a nitrogen, oxygen or sulfur atom, and wherein each carbon and nitrogen atom may be optionally substituted; or each L is optionally and independently an amino acid residue; m is an integer from 0 to 5; n is an integer from 0 to 5; and Y is a functional agent.

In one embodiment, the functional agent comprising the acyl donor substrate is according to formula (I), and wherein Z is a CBZ group; wherein L is a polyethylene glycol moiety (PEG) (—O((CH$_2$)$_2$)—), ethyl amine (—NH((CH$_2$)$_2$)—) or propyl amine (—NH((CH$_2$)$_3$)—); and wherein n is 0, 1, 2 or 3. In another embodiment, the functional agent comprising the acyl donor substrate is according to formula (I), wherein Z is a CBZ group, and wherein L is an amino acid. In one embodiment, L is Gly; m is 1; and n is 1. In one embodiment, the functional agent comprising the acyl donor substrate is according to formula (II), wherein Z is a CBZ group; m is 1; n is 1, 2 or 3; and at least one L is Gly. In one embodiment, L is a polyethylene glycol moiety (PEG). In another embodiment, L comprises one or more amino acids and a polyethylene glycol moiety (PEG). In another embodiment, the functional agent Y is auristatin F.

In one embodiment, the acyl donor substrate is according to one Formulae (III) or (IV):

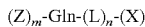

(III)

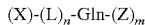

(IV)

wherein Z is a carboxylbenzyloxy (CBZ) group or an amino acid residue; Gln is a glutamine amino acid residue; each L is independently a straight or branched linker from 1 to 20 carbon atoms, wherein one or more of the carbon atoms may be optionally and independently replaced with a nitrogen, oxygen or sulfur atom, and wherein each carbon and nitrogen atom may be optionally substituted; or each L is optionally and independently an amino acid residue; m is an integer from 0 to 5; n is an integer from 0 to 5; and X is a reactive group.

In one embodiment, the acyl donor substrate is according to formula (III), and wherein Z is a CBZ group; wherein L is a polyethylene glycol moiety (PEG) (—O((CH$_2$)$_2$)—), ethyl amine (—NH((CH$_2$)$_2$)—) or propyl amine (—NH((CH$_2$)$_3$)—); and wherein n is 0, 1, 2 or 3. In another embodiment, the acyl donor substrate is according to formula (III), wherein Z is a CBZ group, and wherein L is an amino acid. In one embodiment, L is Gly; m is 1; and n is 1. In another embodiment, the acyl donor substrate is according to formula (IV), wherein Z is a CBZ group; m is 1; n is 1, 2 or 3; and at least one L is Gly. In one embodiment, L is a polyethylene glycol moiety (PEG). In another embodiment, when n is 2-5, then at least one L comprises one or more amino acids and one or more L comprises a polyethylene glycol moiety (PEG).

In one embodiment, X is a reactive group selected from the group consisting of (1R,8S,9s)-bicyclo[6.1.0]non-4-yn-9-ylmethanol (BCN),

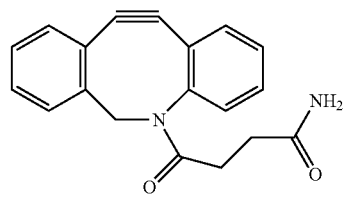

(dibenzocyclooctyne; DBCO), trans-cyclooctene (TCO), azido (N$_3$), alkyne, tetrazine methylcyclopropene, norbornene, hydrazide/hydrazine, and aldehyde.

In one embodiment, the therapeutic agent is an antibody or antigen-binding portion thereof, a chemotherapeutic agent, a drug agent, a radioactive agent, a cytotoxic agent, an antibiotic, a small molecule, nucleic acid, or a polypeptide. In another embodiment, the diagnostic agent is a fluorophore, a fluorescent dye, a radionuclide, or an enzyme.

In one embodiment, the microbial transglutaminase is from *Streptomyces mobaraensis*.

In one embodiment, the immunoglobulin, or antigen-binding portion thereof, is an IgG$_1$ immunoglobulin, or antigen-binding portion thereof. In another embodiment, the immunoglobulin, or antigen-binding portion thereof, is an IgG$_2$, IgG$_3$, or IgG$_4$ immunoglobulin, or antigen-binding portion thereof. In one embodiment, the immunoglobulin, or antigen-binding portion thereof, is an IgA$_1$, an IgA$_2$, or an IgM immunoglobulin, or antigen-binding portion thereof. In one embodiment, the immunoglobulin, or antigen-binding portion thereof, is an IgD or IgE, immunoglobulin, or antigen-binding portion thereof.

In one embodiment, the immunoglobulin, or antigen-binding portion thereof is a human immunoglobulin, or antigen-binding portion thereof, or a humanized immunoglobulin, or antigen-binding portion thereof. In one embodiment, the immunoglobulin, or antigen-binding portion thereof, is a chimeric immunoglobulin or a non-human immunoglobulin, or antigen-binding portion thereof.

In one embodiment, the immunoglobulin, or antigen-binding portion thereof, comprises two heavy chain and two light chains. In one embodiment, there is no intramolecular cross-linking between the two heavy chains of the immunoglobulin, or antigen-binding portion thereof.

In one embodiment, the ratio of functional agent to immunoglobulin, or antigen-binding portion thereof is 1:1 to 200:1 or 1:1 to 100:1.

In one embodiment, the functional agent is an antibody, or antigen-binding portion thereof, and wherein the immunoglobulin, or antigen-binding portion thereof, and the functional agent bind the same antigen or bind different antigens.

In another aspect, described herein is a nucleic acid encoding a conjugatable immunoglobulin. In another aspect, described herein is a plasmid comprising a nucleic acid. In another embodiment, described herein is an isolated cell comprising a plasmid.

In another aspect, described herein is a pharmaceutical composition comprising a conjugated immunoglobulin and a pharmaceutically acceptable carrier.

In one aspect, described herein is a conjugated immunoglobulin produced by any of the methods described herein. In one embodiment, the method further comprises a step of purifying the immunoglobulin conjugated to the glutamine residue of the acyl donor substrate before conjugating the functional agent to the reactive group of the acyl donor substrate. In one embodiment, the purifying step comprises size-based methods, such as chromatography or diafiltration. In another embodiment, the purifying step includes charge-based separation, such as anion exchange or cation exchange chromatography. In another embodiment, the purifying step comprises an affinity-based step, such as Protein A or Protein G chromatography and hydrophobic interaction chromatography (HIC).

BRIEF DESCRIPTION OF THE DRAWINGS

The summary, as well as the following detailed description, is further understood when read in conjunction with the appended drawings. For the purpose of illustrating the disclosed methods, and conjugated immunoglobulins, there are shown in the drawings exemplary embodiments; however, the methods and conjugated immunoglobulins are not limited to the specific embodiments disclosed. In the drawings:

FIG. 2 shows the structures of exemplary Z-Gln-Gly acyl-donor substrates.

FIG. 4, Panels A, B and C, show solvent exposed lysines (stick representation) in human $IgG_1$ Fab and Fc crystal structures; (Panel A) Fab VH-CH1 and Vκ-Cκ, (Panel B) Fab VH-CH1 and Vλ-Cλ, and (Panel C) Fc CH2 and CH3 were determined using Discovery Studio 4.5 with a 1.4 Å probe radius.

FIG. 6 (SEQ ID NOS: 288-290) shows sequences of human $IgG_1$, kappa, and lambda constant domains. Solvent exposed constant domain lysines based on the crystal structures 1FC1 (Fcγ), 4F3F (CH1 and Cκ), and 4HK0 (Cλ) are in bold; lysines within loops are underlined. The constant domains are numbered according the EU numbering system.

FIG. 7 shows the conjugation levels of purified CH1 and hinge mutant mAbs screened for transamidation by incubating mTGase with Z-Gln-Gly-CAD-biotin overnight at 37° C. Biotinylated mAbs were detected by an ELISA as detailed in the Material and Methods and the relative fluorescent units (RFUs) were analyzed. The masses of the HC and LC were analyzed by ESI-MS (data not shown) and the percentage of conjugation was determined.

FIG. 8 shows the conjugation levels of CH1, CH2, CH3 and hinge mutant mAbs previously identified as having the highest conjugation efficiency. MAbs were incubated with Z-Gln-Gly-CAD-biotin and mTGase at 37° C. overnight. The samples were digested with IdeS, reduced, and analyzed by ESI-MS, and the percent conjugation to Z-Gln-Gly-CAD-biotin (Δmass=631 Da) was determined. The DAR was determined by dividing the Δmass by the mass of Z-Gln-Gly-CAD-biotin FIG. 9 shows the conjugation effeiciency of mAbs with multiple acyl acceptor cytes with various acyl donors. MAbs were incubated with Z-Gln-Gly-N3, Z-Gln-Gly-PEG2-BCN, or Z-Gln-Gly-PEG2-AuF and mTGase at 37° C. overnight. The masses of the reduced LCs were analyzed by LC-MS (data not shown), and the percent conjugation to Z-Gln-Gly-CAD-biotin (Δmass=631 Da) was determined.

FIG. 10 (SEQ ID NOS: 291-294) shows the alignment of IgG Fc isotypes. The primary amino acid sequences of human IgG1, 2, 3, and 4 Fc are aligned and differences are highlighted. IgG1 residues Met252, Asn297, and Pro445 are indicated by an X.

FIG. 12 illustrates engineered acyl acceptor sites located through the mAb. The locations of residues engineered with acyl acceptor cites were highlighted in the (A) Fab (4F3F) HC and LC and (B) Fc (1FC1).

DETAILED DESCRIPTION

Figure 1:
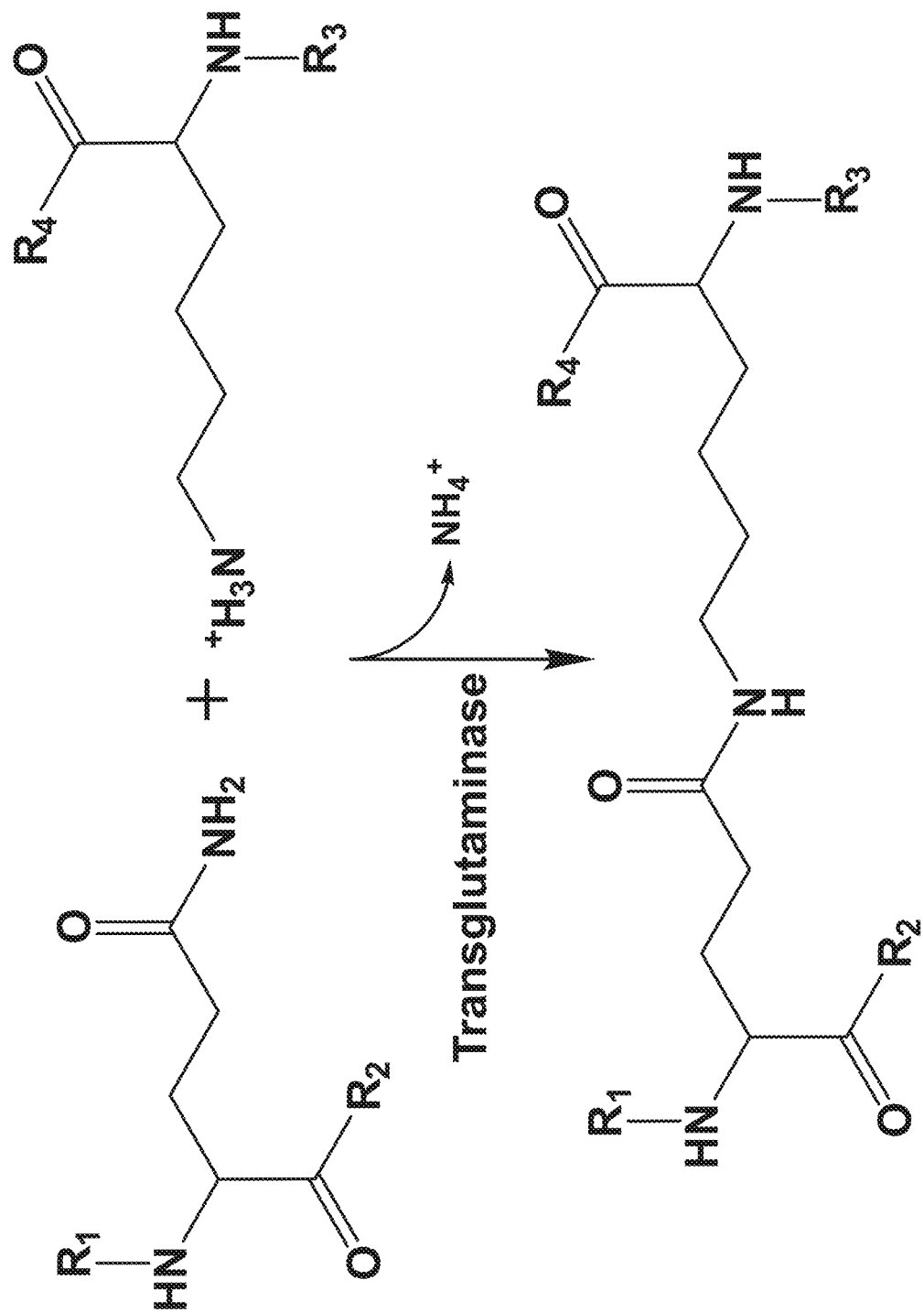
FIG. 1 shows a transglutaminase reaction, wherein the transglutaminase catalyzes the formation of an isopeptide bond between an acyl donor glutamine and an acyl acceptor lysine with release of an ammonia molecule.

The disclosed methods and conjugated immunoglobulins may be understood more readily by reference to the following detailed description taken in connection with the accompanying figures, which form a part of this disclosure. It is to be understood that the disclosed methods and conjugated immunoglobulins are not limited to the specific embodiments described and/or shown herein, and that the terminology used herein is for the purpose of describing particular embodiments by way of example only and is not intended to be limiting of the claimed methods or conjugated immunoglobulins.

Unless specifically stated otherwise, any description as to a possible mechanism or mode of action or reason for improvement is meant to be illustrative only, and the disclosed methods and conjugated immunoglobulins are not to be constrained by the correctness or incorrectness of any such suggested mechanism or mode of action or reason for improvement.

Throughout this text, the descriptions refer to conjugated immunoglobulins and methods of generating the same. Where the disclosure describes or claims a feature or embodiment associated with a conjugated immunoglobulin, such a feature or embodiment is equally applicable to the methods of generating the same. Likewise, where the disclosure describes or claims a feature or embodiment associated with a method of generating a conjugated immunoglobulin, such a feature or embodiment is equally applicable to the conjugated immunoglobulin.

Reference to a particular numerical value includes at least that particular value, unless the context clearly dictates otherwise. When a range of values is expressed, another embodiment includes from the one particular value and/or to the other particular value. Further, reference to values stated in ranges include each and every value within that range. All ranges are inclusive and combinable.

When values are expressed as approximations, by use of the antecedent "about," it will be understood that the particular value forms another embodiment.

It is to be appreciated that certain features of the disclosed methods and conjugated immunoglobulins which are, for clarity, described herein in the context of separate embodiments, may also be provided in combination in a single embodiment. Conversely, various features of the disclosed methods and conjugated immunoglobulins that are, for brevity, described in the context of a single embodiment, may also be provided separately or in any subcombination.

As used herein, the singular forms "a," "an," and "the" include the plural.

Various terms relating to aspects of the description are used throughout the specification and claims. Such terms are to be given their ordinary meaning in the art unless otherwise indicated. Other specifically defined terms are to be construed in a manner consistent with the definitions provided herein.

The term "about" when used in reference to numerical ranges, cutoffs, or specific values is used to indicate that the recited values may vary by up to as much as 10% from the listed value. Thus, the term "about" is used to encompass variations of ±10% or less, variations of ±5% or less, variations of ±1% or less, variations of ±0.5% or less, or variations of ±0.1% or less from the specified value.

In general, the term "engineered" refers to the manipulation of nucleic acid or polypeptide molecules by synthetic means (e.g., by recombinant techniques, in vitro peptide synthesis, by enzymatic or chemical coupling of peptides, or by other methods commonly used in the art).

As used herein, the term "engineered amino acid residue" refers to a non-naturally-occurring amino acid residue within the context of a sequence. As used herein, the term "engineered nucleic acid residue" refers to a non-naturally occurring nucleic acid residue within the context of a sequence. These terms include, for example, a polypeptide sequence or nucleic acid sequence that comprises one or more amino acid or nucleotide changes, including additions, deletions or substitutions, relative to the corresponding naturally occurring polypeptide sequence or nucleic acid sequence, wherein such changes were introduced by recombinant DNA techniques. For instance, an "engineered lysine residue" is a lysine residue that did not exist in the corresponding naturally occurring, or wild-type, polypeptide sequence and was introduced into the polypeptide, either by mutating an existing amino acid residue, or by the insertion of a lysine residue, when sequences of the wild type and the engineered version are aligned. An engineered amino acid residue is not a synthetic amino acid residue. For instance, an engineered lysine residue is not a synthetic lysine residue.

In one embodiment, an "engineered amino acid residue" is an amino acid residue insertion. For example, an amino acid residue or residues may be inserted in between two naturally occurring amino acid residues. In another embodiment, an "engineered amino acid residue" is a naturally occurring amino acid residue which has been mutated to a different amino acid residue. For example, an engineered lysine residue may be a naturally-occurring amino acid residue (e.g., histidine, isoleucine, leucine, methionine, phenylalanine, threonine, tryptophan, valine, alanine, arginine, asparagine, aspartic acid, cysteine, glutamic acid, glutamine, glycine, proline, serine, or tyrosine) which has been mutated, e.g., using recombination DNA techniques, to a lysine residue. Those skilled in the art can readily generate engineered polypeptide sequence useful according to this aspect of the invention. Engineered polypeptide sequences may be produced by any means, including, for example, peptide, polypeptide, or protein synthesis.

As used herein, the term "insertion" or "addition" refers to a change in an amino acid or nucleotide sequence resulting in the addition of one or more amino acid residues or nucleotides, respectively, as compared to the naturally occurring molecule (e.g., the wild-type sequence). The insertion or addition of one or more amino acid residues can take place in-between internal amino acid residues. Alternatively, an insertion may occur at the N-terminus of the amino acid sequence. Alternatively, an insertion may occur at the C-terminus of the amino acid sequence.

The term "natural amino acid," "natural amino acid residue," "naturally occurring amino acid" or "naturally occurring amino acid residue" refers to naturally occurring amino acids which typically occur within the context of a wild-type polypeptide sequence. In other words, a "natural amino acid" has not been mutated or changed in any way to differ from the amino acid residue present in the parent sequence, e.g., naturally occurring sequence. A "natural amino acid" includes amino acids at any position within the polypeptide sequence (e.g., internal amino acid residues) and also any amino acid at the N-terminus or the C-terminus of the polypeptide sequence.

The term "acyl donor substrate" refers to a group with a terminal acyl group on it. Preferably, the "acyl donor substrate" comprises a glutamine residue. An acyl donor substrate may optionally contain a further reactive group. In a first embodiment, the acyl donor substrate is covalently connected to a functional agent. In a second embodiment, the acyl donor substrate is not connected to a functional agent. In one embodiment, the acyl donor substrate comprises a glutamine residue and a reactive group. In another embodiment, the acyl donor substrate comprises one or more linkers, as described further herein. In any of the above embodiments, there is optionally a linker between the acyl donor substrate and the functional agent or between the acyl donor substrate and the reactive group.

The term "antibody", as used herein, broadly refers to any immunoglobulin (Ig) molecule comprised of four polypeptide chains, two heavy (H) chains and two light (L) chains. The term "antibody", as used herein, also refers to any antigen-binding portion, mutant, variant, or derivative of an immunoglobulin molecule, which retains the essential epitope binding features of an Ig molecule. Such mutant, variant, or derivative antibody formats are known in the art and nonlimiting embodiments of which are discussed herein. In one embodiment, the antibody is a humanized antibody. In another embodiment, the antibody is a human antibody. In another embodiment, the antibody is a chimeric antibody. In another embodiment, the antibody is a non-human antibody.

In a full-length antibody, each heavy chain is comprised of a heavy chain variable region (abbreviated herein as HCVR or VH) and a heavy chain constant region. The heavy chain constant region is comprised of three domains, CHL CH2 and CH3. Each light chain is comprised of a light chain variable region (abbreviated herein as LCVR or VL) and a light chain constant region. The light chain constant region is comprised of one domain, CL. The VH and VL regions can be further subdivided into regions of hypervariability, termed complementarity determining regions (CDR), interspersed with regions that are more conserved, termed framework regions (FR). Each VH and VL is composed of three CDRs and four FRs, arranged from amino-terminus to carboxy-terminus in the following order: FR1, CDR1, FR2, CDR2, FR3, CDR3, FR4 Immunoglobulin molecules can be of any type (e.g., IgG, IgE, IgM, IgD, IgA and IgY), class (e.g., $IgG_1$, $IgG_2$, $IgG_3$, $IgG_4$, $IgA_1$ and $IgA_2$) or subclass.

The term "antigen-binding portion" of an antibody (or simply "antibody portion"), as used herein, refers to one or more fragments of an antibody that retain the ability to specifically bind to an antigen. It has been shown that the antigen-binding function of an antibody can be performed by fragments of a full-length antibody. Such antibody embodiments may also be bispecific, dual specific, or multi-specific formats; specifically binding to two or more different antigens. Examples of binding fragments encompassed within the term "antigen-binding portion" of an antibody include (i) a Fab fragment, a monovalent fragment consisting of the VL, VH, CL and CH1 domains; (ii) a Fab' fragment, a Fab containing hinge region not linked by disulfide via either mild reduction or by mutating or deleting cysteines; (iii) a F(ab')$_2$ fragment, a bivalent fragment comprising two Fab fragments linked by a disulfide bridge at the hinge region; (iv) a Fd fragment consisting of the VH and CH1 domains; (v) a Fv fragment consisting of the VL and VH domains of a single arm of an antibody, (vi) a dAb fragment (Ward et al., (1989) Nature 341:544-546, Winter et al., PCT publication WO 90/05144 A1 herein incorporated by reference), which comprises a single variable domain; and (vii) an isolated complementarity determining region (CDR). Furthermore, although the two domains of the Fv fragment, VL and VH, are coded for by separate genes, they can be joined, using recombinant methods, by a synthetic linker that enables them to be made as a single protein chain in which the VL and VH regions pair to form monovalent molecules (known as single chain Fv (scFv); see e.g., Bird et al. (1988) Science 242:423-426; and Huston et al. (1988) Proc. Natl. Acad. Sci. USA 85:5879-5883). Such single chain antibodies are also intended to be encompassed within the term "antigen-binding portion" of an antibody. Other forms of single chain antibodies, such as diabodies are also encompassed. Diabodies are bivalent, bispecific antibodies in which VH and VL domains are expressed on a single polypeptide chain, but using a linker that is too short to allow for pairing between the two domains on the same chain, thereby forcing the domains to pair with complementary domains of another chain and creating two antigen binding sites (see e.g., Holliger, P., et al. (1993) Proc. Natl. Acad. Sci. USA 90:6444-6448; Poljak, R. J., et al. (1994) Structure 2:1121-1123). Such antibody binding portions are known in the art (Kontermann and Dubel eds., Antibody Engineering (2001) Springer-Verlag. New York. 790 pp. (ISBN 3-540-41354-5).

"Acidic Amino Acid" refers to an amino acid exhibiting a negative charge at physiological pH. Genetically encoded acidic amino acids include aspartic acid (Asp; D) and glutamic acid (Glu; E).

"Non-Acidic Amino Acid" refers to an amino acid which is not an acidic amino acid. Non-acidic amino acids include arginine (Arg; R), histidine (His; H), lysine (Lys; K), serine (Ser; S); threonine (Thr; T), asparagine (Asn; N), glutamine (Gln; Q), cysteine (Cys; C), glycine (Gly; G), proline (Pro; P), alanine (Ala; A), valine (Val; V); isoleucine (Ile; I), leucine (Leu; L), methionine (Met; M), phenylalanine (Phe; F), tyrosine (Tyr; Y), and tryptophan (Trp; W).

"Basic Amino Acid" refers to an amino acid exhibiting a positive charge at physiological pH. Genetically encoded basic amino acids include histidine (His; H), lysine (Lys; K), and arginine (Arg; R).

As used herein, the term "biological sample" refers to a sample obtained from a subject, including sample of biological tissue or fluid origin obtained in vivo or in vitro. Such samples can be, but are not limited to, body fluid (e.g., blood, blood plasma, serum, milk, spinal fluid, ascites, or urine), organs, tissues, fractions, and cells isolated from mammals including, humans Biological samples also may include sections of the biological sample including tissues (e.g., sectional portions of an organ or tissue). Biological samples may also include extracts from a biological sample, for example, an antigen from a biological fluid (e.g., blood or urine).

The term "click chemistry" refers to particular reactions for protein synthesis and/or conjugation which are high yield, highly-selective, reliable and clean. See, e.g., King et al., "Developments in the Field of Bioorthagonal Bond Forming Reactions—Past and Present Trends", Bioconjug. Chem., (2014) 25(5): 825-839; McKay et al., "Click Chemistry in Complex Mixtures: Bioorthagonal Bioconjugation", Chem. Biol., (2014) 21(9): 1075-1101.

The term "chimerized," "chimeric," "chimeric antibody" and like terms refer to an immunoglobulin comprising a heavy chain variable region and light chain variable region, i.e., antigen-binding region, from one source or species and at least a portion of a heavy chain constant region and light chain constant region derived from a different source or species. These portions may be joined together chemically by conventional techniques (e.g., synthetic) or prepared as a contiguous polypeptide using genetic engineering techniques (e.g., DNA encoding the protein portions of the chimeric antibody may be expressed to produce a contiguous polypeptide chain) Other forms of "chimeric immunoglobulins" encompassed by the present disclosure are those in which the class or subclass has been modified or changed from that of the original immunoglobulin (also referred to as "class-switched immunoglobulins"). Throughout the disclosure, chimeric immunoglobulins are designated "xi." Herein, "chimeric immunoglobulin" and like terms refer to the sequence of the immunoglobulin rather than the process used to generate the antibody.

As used herein, "functional agent" refers to an agent having therapeutic, diagnostic, or other functional property(ies). In one embodiment, a functional agent may be a therapeutic agent. In another embodiment, a functional agent may be a diagnostic agent. Functional agents may be large molecules or small molecules. Large molecule functional agents include, but are not limited to, an antibody and antigen-binding portions thereof. Small molecule functional agents include, but are not limited to, chemotherapeutic agents, cytotoxic agents, antibiotics, other organic compounds which may regulate biological process (e.g., drugs), and polypeptides.

The term "humanized," "humanized immunoglobulin" and like terms refer to immunoglobulins in which the framework or "complementarity determining regions" (CDR) have been modified to comprise the CDR of an immunoglobulin of different specificity as compared to that of the parent immunoglobulin. For the most part, humanized immunoglobulins are human immunoglobulins (recipient immunoglobulin) in which residues from a hypervariable region of the recipient are replaced by residues from a hypervariable region of a non-human species (donor immunoglobulin) such as mouse, rat, rabbit or nonhuman primate having the desired specificity, affinity, and capacity. In some instances, FR residues of the human immunoglobulin are replaced by corresponding non-human residues. Furthermore, humanized immunoglobulins may comprise residues that are not found in the recipient immunoglobulin or in the donor immunoglobulin. These modifications are made to further refine immunoglobulin performance. In general, the humanized immunoglobulin will comprise substantially all of at least one, and typically two, variable domains, in which all or substantially all of the hypervariable loops correspond to those of a non-human immunoglobulin and all or substantially all of the FRs are those of a human immunoglobulin sequence. The humanized immunoglobulin can optionally also comprise at least a portion of an immunoglobulin constant region (Fc), typically that of a human immunoglobulin. See, e.g., Riechmann, L., et al., Nature 332 (1988) 323-327; and Neuberger, M. S., et al., Nature 314 (1985) 268-270. Herein, "humanized immunoglobulin" and like terms refer to the sequence of the immunoglobulin rather than the process used to generate the immunoglobulin.

The term "diagnostic agent" refers to a compound which may be useful for in vivo imaging studies such as CT, MRI and X-ray and/or in vitro imaging studies. Non-limiting examples of diagnostic agents include a fluorophore, a fluorescent dye, a radionuclide, and an enzyme.

The term "donor immunoglobulin" refers to a non-human immunoglobulin that contributes the amino acid sequences of its variable regions, CDRs, or other functional fragments or analogs thereof to the humanized immunoglobulin, and thereby provides the humanized immunoglobulin with the antigenic specificity and neutralizing activity characteristic of the donor immunoglobulin.

The term "recipient immunoglobulin" refers to an immunoglobulin heterologous to the donor immunoglobulin, which provides the amino acid sequences of its heavy and/or light chain framework regions and/or its heavy and/or light chain constant regions to the humanized immunoglobulin. The recipient immunoglobulin may be derived from any mammal. In preferred embodiments, the recipient immunoglobulin is non-immunogenic in humans Preferably the recipient immunoglobulin is a human immunoglobulin.

"Humanizing" refers to a process of generating a humanized immunoglobulin and includes any process for generating humanized immunoglobulins having the above characteristics, including, but not limited to, in silico humanization, engineering species/host CDRs into human immunoglobulins, substituting framework region residues of a chimeric immunoglobulin to match a corresponding human framework region, etc.

"Immunoglobulin," as used herein, refers to a protein consisting of one or more polypeptides substantially encoded by immunoglobulin genes including the kappa and lambda light chains and the alpha, gamma, delta, epsilon and mu heavy chains. Full-length immunoglobulin "light chains" (about 25 Kd or 214 amino acids) are encoded by a variable region gene at the $NH_2$-terminus (about 110 amino acids) and a kappa or lambda constant region gene at the COOH—terminus. Full-length immunoglobulin "heavy chains" (about 50 Kd or 446 amino acids), are similarly encoded by a variable region gene (about 116 amino acids) and one of the other aforementioned constant region genes, e.g., gamma (encoding about 330 amino acids). "Immunoglobulins" include: (a) immunoglobulin polypeptides, i.e., polypeptides of the immunoglobulin family that contain an antigen binding site that specifically binds to a specific antigen, including all immunoglobulin isotypes (IgG, IgA, IgE, IgM, IgD, and IgY), classes (e.g., $IgG_1$, $IgG_2$, $IgG_3$, $IgG_4$, $IgA_1$, $IgA_2$), subclasses, and various monomeric and polymeric forms of each isotype, unless otherwise specified; and (b) conservatively substituted variants of such immunoglobulin polypeptides that immunospecifically bind to the antigen Immunoglobulins are generally described in, for example, Harlow & Lane, Antibodies: A Laboratory Manual (Cold Spring Harbor Laboratory Press, 1988).

The term "microbial transglutaminase" refers to a type of transferase that catalyzes an acyl transfer reaction. A preferred embodiment comprises the use of a microbial transglutaminase to catalyze an acyl transfer reaction between a first moiety containing a glutamine residue (acyl donor) and a second moiety containing a primary amine group (acyl acceptor). It is preferable that the reactive glutamine residue is solvent exposed.

One form of immunoglobulin disclosed herein constitutes the basic structural unit of an antibody. For example, an antibody can include a tetramer and consist of two identical pairs of immunoglobulin chains, each pair having one light chain and one heavy chain. Generally, in each pair, the light chain and heavy chain variable regions are together responsible for binding to an antigen, and the constant regions are responsible for the antibody effector functions.

In addition to antibodies, immunoglobulins may exist in a variety of other forms including, for example: antigen-binding fragments or portions of a full-length immunoglobulin, such as Fv, Fab, $(Fab')_2$ and Fv fragments; and alternative antibody formats such as single chain immunoglobulins (scFV and scFab), diabodies, triabodies, tetrabodies, linear antibodies, and multispecific antibodies, to name a few. See, for example, James D. Marks, Antibody Engineering, Chapter 2, Oxford University Press (1995) (Carl K. Borrebaeck, Ed.).

In one embodiment, an immunoglobulin may comprise an Fab fragment. In another embodiment, an immunoglobulin may comprise a CH3 domain. In another embodiment, an immunoglobulin may comprise a heavy chain.

As used herein, the term "immunospecifically" refers to the ability of an immunoglobulin to specifically bind to an antigen against which the immunoglobulin was generated and not specifically bind to other peptides or proteins. An immunoglobulin that immunospecifically binds to an antigen against which the immunoglobulin was generated may not bind to other polypeptides or proteins, or may bind to other polypeptides or proteins with a lower binding affinity than the antigen against which the immunoglobulin was generated as determined by, for example, immunoassays, BIAcore, or other assays known in the art. An immunoglobulin binds immunospecifically to an antigen against which the immunoglobulin was generated when it binds to the antigen with a higher binding affinity than to any cross-reactive antigen as determined using experimental techniques, such as, but not limited to, radioimmunoassays (RIA) and enzyme-linked immunosorbent assays (ELISAs) (See, for example, Paul, ed., Fundamental Immunology, 2nd ed., Raven Press, New York, pages 332-336 (1989) for a discussion regarding antibody specificity.).

"Linker," as used herein, refers to a spacer, which may be a straight or branched chain, for connecting an immunoglobulin (through an acyl donor substrate) to a functional agent or a reactive group. Such linkers may be cleavable (e.g., acid labile or protease cleavable) or non-cleavable. In one embodiment, a linker is a polyethylene glycol (PEG) moiety. In another embodiment, a linker comprises one or more amino acids and a polyethylene glycol moiety (PEG).

The term "monoclonal antibody" refers to an antibody that is derived from a single cell clone, including any eukaryotic or prokaryotic cell clone, or a phage clone, and not the method by which it is produced. A monoclonal antibody displays a single binding specificity and affinity for a particular epitope. The term "monoclonal antibody" is not limited to antibodies produced through hybridoma technology.

"Native" refers to the wild type immunoglobulin sequence from the species in which the immunoglobulin is derived.

As used herein, "percent identity" and like terms is used to describe the sequence relationships between two or more nucleic acids, polynucleotides, proteins, or polypeptides, and is understood in the context of and in conjunction with the terms including: (a) reference sequence, (b) comparison window, (c) sequence identity and (d) percentage of sequence identity.

(a) A "reference sequence" is a defined sequence used as a basis for sequence comparison. A reference sequence may be a subset of or the entirety of a specified sequence; for example, a segment of a full-length cDNA or gene sequence, or the complete cDNA or gene sequence. For polypeptides, exemplary lengths of the reference polypeptide sequence include at least about 16 amino acids, at least about 20 amino acids, at least about 25 amino acids, at least about 35 amino acids, at least about 50 amino acids, or at least about 100 amino acids. For nucleic acids, exemplary length of the reference nucleic acid sequence include at least about 50 nucleotides, at least about 60 nucleotides, at least about 75 nucleotides, at least about 100 nucleotides, or at least about 300 nucleotides, or any integer thereabout or therebetween.

(b) A "comparison window" includes reference to a contiguous and specified segment of a polynucleotide or polypeptide sequence, wherein the polynucleotide or polypeptide sequence may be compared to a reference sequence and wherein the portion of the polynucleotide or polypeptide sequence in the comparison window may comprise additions, substitutions, or deletions (i.e., gaps) compared to the reference sequence (which does not comprise additions, substitutions, or deletions) for optimal alignment of the two sequences. Exemplary comparison windows can be at least 20 contiguous nucleotides or amino acids in length, and optionally may be 30, 40, 50, 100, or longer. Those of skill in the art understand that to avoid a misleadingly high similarity to a reference sequence due to inclusion of gaps in the polynucleotide or polypeptide sequence a gap penalty is typically introduced and is subtracted from the number of matches.

(c) Methods of alignment of sequences for comparison are well known in the art. Optimal alignment of sequences for comparison may be conducted by the local homology algorithm of Smith and Waterman, Adv. Appl. Math., 2: 482, 1981; by the homology alignment algorithm of Needleman and Wunsch, J. Mol. Biol., 48: 443, 1970; by the search for similarity method of Pearson and Lipman, Proc. Natl. Acad. Sci. USA, 8: 2444, 1988; by computerized implementations of these algorithms, including, but not limited to: CLUSTAL in the PC/Gene program by Intelligenetics, Mountain View, Calif., GAP, BESTFIT, BLAST, FASTA, and TFASTA in the Wisconsin Genetics Software Package, Genetics Computer Group (GCG), 7 Science Dr., Madison, Wis., USA; the CLUSTAL program is well described by Higgins and Sharp, Gene, 73: 237-244, 1988; Corpet, et al., Nucleic Acids Research, 16:881-90, 1988; Huang, et al., Computer Applications in the Biosciences, 8:1-6, 1992; and Pearson, et al., Methods in Molecular Biology, 24:7-331, 1994. The BLAST family of programs which may be used for database similarity searches includes: BLASTN for nucleotide query sequences against nucleotide database sequences; BLASTX for nucleotide query sequences against protein database sequences; BLASTP for protein query sequences against protein database sequences; TBLASTN for protein query sequences against nucleotide database sequences; and TBLASTX for nucleotide query sequences against nucleotide database sequences. See, Current Protocols in Molecular Biology, Chapter 19, Ausubel, et al., Eds., Greene Publishing and Wiley-Interscience, New York, 1995. New versions of the above programs or new programs altogether will undoubtedly become available in the future, and may be used with the present disclosure.

(d) "Percent identity" means the value determined by comparing two optimally aligned sequences over a comparison window, wherein the portion of the polynucleotide or polypeptide sequence in the comparison window may comprise additions, substitutions, or deletions (i.e., gaps) as compared to the reference sequence (which does not comprise additions, substitutions, or deletions) for optimal alignment of the two sequences. The percentage is calculated by determining the number of positions at which the identical nucleic acid base or amino acid residue occurs in both sequences to yield the number of matched positions, dividing the number of matched positions by the total number of positions in the window of comparison and multiplying the result by 100 to yield the percentage of sequence identity.

"Pharmaceutically effective amount" refers to an amount of an immunoglobulin that treats a subject.

"Pharmaceutically acceptable carrier" refers to components of a pharmaceutical formulation for an immunoglobulin as described herein for administration to a subject. For example, a pharmaceutically acceptable carrier may be a liposome-based, lipid-based and/or nano-particle-based.

The term "reactive group" as used here in refers to a chemical functional group which may react to other compounds, such as functional agents, to form at least one covalent bond. In one embodiment, reactive groups are reactive in click chemistry coupling reactions. Non-limiting examples of reactive groups include (1R,8S,9s)-bicyclo [6.1.0]non-4-yn-9-ylmethanol (BCN),

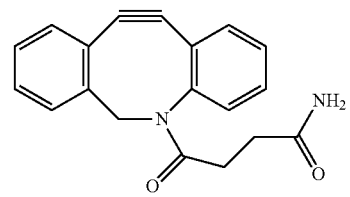 [SMILES: NC(=O)CCC(=O)N1Cc2ccccc2C#Cc2ccccc21]

(dibenzocyclooctyne; DBCO), trans-cyclooctene (TCO), azido ($N_3$), alkyne, tetrazine methylcyclopropene, norbornene, hydrazide/hydrazine, and aldehyde.

The term "subject" as used herein refers to a human or non-human organism. Thus, the methods, immunoglobulins, and conjugated immunoglobulins described herein are applicable to both human and veterinary diseases and conditions. Subjects can be "patients," i.e., living humans or non-human organisms that are receiving medical care for a disease or condition, or humans or non-human organisms with no defined illness who are being investigated for signs of pathology or presence/absence of a particular condition.

"Substituting" refers to the replacement of one amino acid residue for another. "Substituting" includes, for example, missense mutations in one or more DNA base pairs encoding the amino acid residue or engineering the protein to exchange one amino acid with another.

As used herein, "treating" and like terms refer to reducing the severity and/or frequency of disease symptoms, eliminating disease symptoms and/or the underlying cause of said symptoms, reducing the frequency or likelihood of disease symptoms and/or their underlying cause, and improving or remediating damage caused, directly or indirectly, by disease.

The term "therapeutic agent" means a large or small molecule which may be administered to a subject in need thereof to treat a condition. Therapeutic agents may be administered to treat, or prevent the onset, slow the progression, or to ameliorate one or more symptoms of a medical condition in subjects suffering from the same. Therapeutic agents include, but are not limited to, an antibody or antigen-binding portion thereof, a chemotherapeutic agent, a radioactive agent, a cytotoxic agent, an antibiotic, etc. In one embodiment, the therapeutic agent is a small molecule. In another embodiment, the therapeutic agent is a polypeptide.

As used herein "90% identical to" encompasses at least 90% identical, 91% identical, 92% identical, 93% identical, 94% identical, 95% identical, 96% identical, 97% identical, 98% identical, 99% identical, or 100% identical to the reference item (e.g., a biological sequence).

The following abbreviations are used throughout the disclosure: antibody drug conjugates (ADCs); drug-to-antibody ratio (DAR); frame work region (FR); complementary determining region (CDR); auristatin F (AuF); variable heavy region (VH); variable light region (VL); variable kappa (Vκ); gamma constant region (Cγ); kappa constant region (CIO; monoclonal antibody (mAb); lysine at amino acid position 447 of the heavy chain of the immunoglobulin, as numbered using the EU numbering system (Lys447).

Generation of Conjugated Immunoglobulins

Disclosed herein are methods for generating a conjugated immunoglobulin, the methods comprising: contacting an immunoglobulin, or an antigen-binding portion thereof, with a microbial transglutaminase and a functional agent comprising an acyl donor substrate, a) wherein the immunoglobulin, or antigen-binding portion thereof, comprises an engineered lysine residue, wherein the engineered lysine residue is a lysine residue insertion or a natural amino acid residue which has been mutated to a lysine residue, b) wherein the acyl donor substrate comprises a glutamine residue, and c) wherein the functional agent is a therapeutic agent or a diagnostic agent, wherein the microbial transglutaminase conjugates the engineered lysine residue of the immunoglobulin, or antigen-binding portion thereof, to the glutamine residue of the acyl donor substrate on the functional agent, thereby generating the conjugated immunoglobulin.

Also disclosed herein are methods for generating a conjugated immunoglobulin, the methods comprising: i) contacting an immunoglobulin, or antigen-binding portion thereof, with a microbial transglutaminase and an acyl donor substrate, a) wherein the immunoglobulin, or antigen-binding portion thereof, comprises an engineered lysine residue, wherein the engineered lysine residue is a lysine residue insertion or a natural amino acid residue which has been mutated to a lysine residue, b) wherein the acyl donor substrate comprises a glutamine residue and a reactive group, wherein the microbial transglutaminase conjugates the engineered lysine residue of the immunoglobulin, or antigen-binding portion thereof, to the glutamine residue of the acyl donor substrate, and ii) conjugating a functional agent to the reactive group of the acyl donor substrate, wherein the functional agent is a therapeutic agent or a diagnostic agent, thereby generating the conjugated immunoglobulin.

Conjugation can be performed by dissolving a functional agent comprising an acyl donor substrate in a dissolution solution and contacting the dissolved functional agent with the immunoglobulin, or antigen-binding portion thereof, and microbial transglutaminase in a conjugation buffer. Conjugation may also be performed by dissolving a acyl donor substrate in a dissolution solution and contacting the acyl donor substrate with the immunoglobulin, or antigen-binding portion thereof, and microbial transglutaminase in a conjugation buffer.

For aqueous-insoluble functional agents and acyl donor substrates, suitable dissolution solutions include organic, water-miscible solvents such as dimethylsulfoxide (DMSO). For aqueous-soluble functional agents and acyl donor substrates, suitable dissolution solutions include, but are not limited to, water or buffered aqueous solutions, such as phosphate-buffered saline, pH 7.2 (1×PBS) or DPBS.

Suitable concentrations of the functional agent or the acyl donor substrate include from about 10 µM to about 800 mM, from about 10 mM to about 100 mM, from about 25 mM to about 100 mM, from about 40 mM to about 100 mM, from about 55 mM to about 100 mM, from about 70 mM to about 100 mM, from about 10 mM to about 90 mM, from about 10 mM to about 75 mM, from about 10 mM to about 60 mM, from about 10 mM to about 50 mM, from about 10 mM to about 40 mM, or from about 10 mM to about 30 mM.

In some embodiments, the concentration of the functional agent or the acyl donor substrate can be about 10 µM. In some embodiments, the concentration of the functional agent or the acyl donor substrate can be about 25 µM. In some embodiments, the concentration of the functional agent or the acyl donor substrate can be about 50 µM. In some embodiments, the concentration of the functional agent or the acyl donor substrate can be about 100 µM. In some embodiments, the concentration of the functional agent or the acyl donor substrate can be about 250 µM. In some embodiments, the concentration of the functional agent or the acyl donor substrate can be about 500 µM. In some embodiments, the concentration of the functional agent or the acyl donor substrate can be about 750 µM. In some embodiments, the concentration of the functional agent or the acyl donor substrate can be about 1 mM. In some embodiments, the concentration of the functional agent or the acyl donor substrate can be about 10 mM. In some embodiments, the concentration of the functional agent or the acyl donor substrate can be about 20 mM. In some embodiments, the concentration of the functional agent or the acyl donor substrate can be about 30 mM. In some embodiments, the concentration of the functional agent or the acyl donor substrate can be about 40 mM. In some embodiments, the concentration of the functional agent or the acyl donor substrate can be about 50 mM. In some embodiments, the concentration of the functional agent or the acyl donor substrate can be about 60 mM. In some embodiments, the concentration of the functional agent or the acyl donor substrate can be about 70 mM. In some embodiments, the concentration of the functional agent or the acyl donor substrate can be about 80 mM. In some embodiments, the concentration of the functional agent or the acyl donor substrate can be about 90 mM. In some embodiments, the concentration of the functional agent or the acyl donor substrate can be about 100 mM. In some embodiments, the concentration of the functional agent or the acyl donor substrate can be about 150 mM. In some embodiments, the concentration of the functional agent or the acyl donor substrate can be about 200 mM. In some embodiments, the concentration of the functional agent or the acyl donor substrate can be about 250 mM. In some embodiments, the concentration of the functional agent or the acyl donor substrate can be about 300 mM. In some embodiments, the concentration of the functional agent or the acyl donor substrate can be about 350 mM. In some embodiments, the concentration of the functional agent or the acyl donor substrate can be about 400 mM. In some embodiments, the concentration of the functional agent or the acyl donor substrate can be about 450 mM. In some embodiments, the concentration of the functional agent or the acyl donor substrate can be about 500 mM. In some embodiments, the concentration of the functional agent or the acyl donor substrate can be about 550 mM. In some embodiments, the concentration of the functional agent or the acyl donor substrate can be about 600 mM. In some embodiments, the concentration of the functional agent or the acyl donor substrate can be about 650 mM. In some embodiments, the concentration of the functional agent or the acyl donor substrate can be about 700 mM. In some embodiments, the concentration of the functional agent or the acyl donor substrate can be about 750 mM. In some embodiments, the concentration of the functional agent or the acyl donor substrate can be about 800 mM.

Suitable concentrations of immunoglobulin include from about 0.1 mg/ml to about 100 mg/ml, from about 0.5 mg/ml to about 20 mg/ml, from about 1 mg/ml to about 20 mg/ml, from about 5 mg/ml to about 20 mg/ml, from about 10 mg/ml to about 20 mg/ml, from about 0.1 mg/ml to about 15 mg/ml, from about 0.1 mg/ml to about 12 mg/ml, from about 0.1 mg/ml to about 10 mg/ml, from about 0.1 mg/ml to about 5 mg/ml, or from about 0.1 mg/ml to about 2 mg/ml, from about 10 mg/ml to about 30 mg/ml, from about 20 mg/ml to about 45 mg/ml, from about 35 mg/ml to about 50 mg/ml, from about 45 mg/ml to about 60 mg/ml, from about 50 mg/ml to about 75 mg/ml, from about 60 mg/ml to about 85 mg/ml or from about 80 mg/ml to about 100 mg/ml. In some embodiments, the concentration of immunoglobulin can be about 0.1 mg/ml. In some embodiments, the concentration of immunoglobulin can be about 0.5 mg/ml. In some embodiments, the concentration of immunoglobulin can be about 1 mg/ml. In some embodiments, the concentration of immunoglobulin can be about 2 mg/ml. In some embodiments, the concentration of immunoglobulin can be about 5 mg/ml. In some embodiments, the concentration of immunoglobulin can be about 10 mg/ml. In some embodiments, the concentration of immunoglobulin can be about 15 mg/ml. In some embodiments, the concentration of immunoglobulin can be about 20 mg/ml. In some embodiments, the concentration of immunoglobulin can be about 25 mg/ml. In some embodiments, the concentration of immunoglobulin can be about 30 mg/ml. In some embodiments, the concentration of immunoglobulin can be about 35 mg/ml. In some embodiments, the concentration of immunoglobulin can be about 40 mg/ml. In some embodiments, the concentration of immunoglobulin can be about 45 mg/ml. In some embodiments, the concentration of immunoglobulin can be about 50 mg/ml. In some embodiments, the concentration of immunoglobulin can be about 55 mg/ml. In some embodiments, the concentration of immunoglobulin can be about 60 mg/ml. In some embodiments, the concentration of immunoglobulin can be about 65 mg/ml. In some embodiments, the concentration of immunoglobulin can be about 70 mg/ml. In some embodiments, the concentration of immunoglobulin can be about 75 mg/ml. In some embodiments, the concentration of immunoglobulin can be about 80 mg/ml. In some embodiments, the concentration of immunoglobulin can be about 85 mg/ml. In some embodiments, the concentration of immunoglobulin can be about 90 mg/ml. In some embodiments, the concentration of immunoglobulin can be about 95 mg/ml. In some embodiments, the concentration of immunoglobulin can be about 100 mg/ml.

Suitable ratios of a functional agent or an acyl donor substrate:immunoglobulin include from about 1:1 to 100:1. In one embodiment, the ratio of functional agent to acyl donor substrate:immunoglobulin is about 25:1 to about 75:1. In another embodiment, the ratio of functional agent to acyl donor substrate:immunoglobulin is about 40:1 to about 60:1. In some embodiments, the ratio of a functional agent or an acyl donor substrate:immunoglobulin can be 1:1. In some embodiments, the ratio of a functional agent or an acyl donor substrate:immunoglobulin can be 2:1. In some embodiments, the ratio of a functional agent or an acyl donor substrate:immunoglobulin can be 3:1. In some embodiments, the ratio of a functional agent or an acyl donor substrate:immunoglobulin can be 4:1. In some embodiments, the ratio of a functional agent or an acyl donor substrate:immunoglobulin can be 5:1. In some embodiments, the ratio of a functional agent or an acyl donor substrate:immunoglobulin can be 6:1. In some embodiments, the ratio of a functional agent or an acyl donor substrate:immunoglobulin can be 7:1. In some embodiments, the ratio of a functional agent or an acyl donor substrate:immunoglobulin can be 8:1. In some embodiments, the ratio of a functional agent or an acyl donor substrate:immunoglobulin can be 9:1. In some embodiments, the ratio of a functional agent or an acyl donor substrate:immunoglobulin can be 10:1. In some embodiments, the ratio of a functional agent or an acyl donor substrate:immunoglobulin can be 11:1. In some embodiments, the ratio of a functional agent or an acyl donor substrate:immunoglobulin can be 12:1. In some embodiments, the ratio of a functional agent or an acyl donor substrate:immunoglobulin can be 13:1. In some embodiments, the ratio of a functional agent or an acyl donor substrate:immunoglobulin can be 14:1. In some embodiments, the ratio of a functional agent or an acyl donor substrate:immunoglobulin can be 15:1. In some embodiments, the ratio of a functional agent or an acyl donor substrate:immunoglobulin can be 16:1. In some embodiments, the ratio of a functional agent or an acyl donor substrate:immunoglobulin can be 17:1. In some embodiments, the ratio of a functional agent or an acyl donor substrate:immunoglobulin can be 18:1. In some embodiments, the ratio of a functional agent or an acyl donor substrate:immunoglobulin can be 19:1. In some embodiments, the ratio of a functional agent or an acyl donor substrate:immunoglobulin can be 20:1. In some embodiments, the ratio of a functional agent or an acyl donor substrate:immunoglobulin can be 25:1. In some embodiments, the ratio of a functional agent or an acyl donor substrate:immunoglobulin can be 30:1. In some embodiments, the ratio of a functional agent or an acyl donor substrate:immunoglobulin can be 35:1. In some embodiments, the ratio of a functional agent or an acyl donor substrate:immunoglobulin can be 40:1. In some embodiments, the ratio of a functional agent or an acyl donor substrate:immunoglobulin can be 45:1. In some embodiments, the ratio of a functional agent or an acyl donor substrate:immunoglobulin can be 50:1. In some embodiments, the ratio of a functional agent or an acyl donor substrate:immunoglobulin can be 60:1. In some embodiments, the ratio of a functional agent or an acyl donor substrate:immunoglobulin can be 70:1. In some embodiments, the ratio of a functional agent or an acyl donor substrate:immunoglobulin can be 80:1. In some embodiments, the ratio of a functional agent or an acyl donor substrate:immunoglobulin can be 90:1. In some embodiments, the ratio of a functional agent or an acyl donor substrate:immunoglobulin can be 100:1.

The contacting can be performed in a number of suitable conjugation buffers including, for example, DPBS, 1×PBS, pH 7.2, sodium phosphate, potassium phosphate, sodium borate, Tris, and HEPES, to name a few. The concentration of conjugation buffer include from about 5 mM to about 2 M, from about 5 mM to about 1 M, from about 5 mM to about 500 mM, from about 5 mM to about 100 mM, from about 10 mM to about 100 mM, from about 20 mM to about 100 mM, from about 30 mM to about 100 mM, from about 45 mM to about 100 mM, from about 60 mM to about 100 mM, from about 75 mM to about 100 mM, from about 10 mM to about 90 mM, from about 10 mM to about 75 mM, from about 10 mM to about 60 mM, from about 10 mM to about 45 mM, or from about 10 mM to about 30 mM. In some embodiments, the concentration of the conjugation buffer can be about 10 mM. In some embodiments, the concentration of the conjugation buffer can be about 20 mM. In some embodiments, the concentration of the conjugation buffer can be about 30 mM. In some embodiments, the concentration of the conjugation buffer can be about 40 mM. In some embodiments, the concentration of the conjugation buffer can be about 50 mM. In some embodiments, the concentration of the conjugation buffer can be about 60 mM. In some embodiments, the concentration of the conjugation buffer can be about 70 mM. In some embodiments, the concentration of the conjugation buffer can be about 80 mM. In some embodiments, the concentration of the conjugation buffer can be about 90 mM. In some embodiments, the concentration of the conjugation buffer can be about 100 mM. In some embodiments, the concentration of the conjugation buffer can be about 250 mM. In some embodiments, the concentration of the conjugation buffer can be about 500 mM. In some embodiments, the concentration of the conjugation buffer can be about 750 mM. In some embodiments, the concentration of the conjugation buffer can be about 1 M. In some embodiments, the concentration of the conjugation buffer can be about 1.25 M. In some embodiments, the concentration of the conjugation buffer can be about 1.5 M. In some embodiments, the concentration of the conjugation buffer can be about 1.75 M. In some embodiments, the concentration of the conjugation buffer can be about 2 M.

The conjugation buffer can further include sodium chloride. Suitable concentrations of sodium chloride include from about 0 mM to about 2 M, from about 0 mM to about 1 M, from about 1 M to about 2 M, from about 500 mM to about 1.5 M, from about 25 mM to about 500 mM, from about 50 mM to about 500 mM, from about 75 mM to about 500 mM, from about 100 mM to about 500 mM, from about 150 mM to about 500 mM, from about 200 mM to about 500 mM, from about 250 mM to about 500 mM, from about 300 mM to about 500 mM, from about 350 mM to about 500 mM, from about 400 mM to about 500 mM, from about 0 mM to about 400 mM, from about 0 mM to about 350 mM, from about 0 mM to about 300 mM, from about 0 mM to about 250 mM, from about 0 mM to about 200 mM, from about 0 mM to about 150 mM, from about 0 mM to about 100 mM, from about 0 mM to about 50 mM, or from about 0 mM to about 25 mM. In some embodiments, the concentration of sodium chloride can be about 25 mM. In some embodiments, the concentration of sodium chloride can be about 50 mM. In some embodiments, the concentration of sodium chloride can be about 75 mM. In some embodiments, the concentration of sodium chloride can be about 100 mM. In some embodiments, the concentration of sodium chloride can be about 150 mM. In some embodiments, the concentration of sodium chloride can be about 200 mM. In some embodiments, the concentration of sodium chloride can be about 250 mM. In some embodiments, the concentration of sodium chloride can be about 300 mM. In some embodiments, the concentration of sodium chloride can be about 350 mM. In some embodiments, the concentration of sodium chloride can be about 400 mM. In some embodiments, the concentration of sodium chloride can be about 500 mM. In some embodiments, the concentration of sodium chloride can be about 750 mM. In some embodiments, the concentration of sodium chloride can be about 1 M. In some embodiments, the concentration of sodium chloride can be about 1.25 M. In some embodiments, the concentration of sodium chloride can be about 1.5 M. In some embodiments, the concentration of sodium chloride can be about 1.75 M. In some embodiments, the concentration of sodium chloride can be about 2 M.

The pH of the conjugation buffer can be from about 4 to about 9. In some embodiments, the pH of the conjugation buffer can be about 5 to about 8. In another embodiment, the pH of the conjugation buffer can be about 6 to about 7. In some embodiments, the pH of the conjugation buffer can be about 4. In some embodiments, the pH of the conjugation buffer can be about 4.5. In some embodiments, the pH of the conjugation buffer can be about 5. In some embodiments, the pH of the conjugation buffer can be about 5.5. In some embodiments, the pH of the conjugation buffer can be about 6.0. In some embodiments, the pH of the conjugation buffer can be about 6.5. In some embodiments, the pH of the conjugation buffer can be about 6.6. In some embodiments, the pH of the conjugation buffer can be about 6.7. In some embodiments, the pH of the conjugation buffer can be about 6.8. In some embodiments, the pH of the conjugation buffer can be about 6.9. In some embodiments, the pH of the conjugation buffer can be about 7.0. In some embodiments, the pH of the conjugation buffer can be about 7.1. In some embodiments, the pH of the conjugation buffer can be about 7.2. In some embodiments, the pH of the conjugation buffer can be about 7.3. In some embodiments, the pH of the conjugation buffer can be about 7.4. In some embodiments, the pH of the conjugation buffer can be about 7.5. In some embodiments, the pH of the conjugation buffer can be about 7.6. In some embodiments, the pH of the conjugation buffer can be about 7.7. In some embodiments, the pH of the conjugation buffer can be about 7.8. In some embodiments, the pH of the conjugation buffer can be about 7.9. In some embodiments, the pH of the conjugation buffer can be about 8.0. In some embodiments, the pH of the conjugation buffer can be about 8.1. In some embodiments, the pH of the conjugation buffer can be about 8.2. In some embodiments, the pH of the conjugation buffer can be about 8.3. In some embodiments, the pH of the conjugation buffer can be about 8.4. In some embodiments, the pH of the conjugation buffer can be about 8.5. In some embodiments, the pH of the conjugation buffer can be about 9.

To facilitate solubility of a functional agent or an acyl donor substrate in the conjugation buffer, a final concentration of organic, water-miscible solvent in the conjugation buffer may be from about 0% to about 20%, from about 2% to about 20%, from about 5% to about 20%, from about 8% to about 20%, from about 11% to about 20%, from about 16% to about 20%, from about 0% to about 18%, from about 0% to about 15%, from about 0% to about 12%, from about 0% to about 10%, from about 0% to about 8%, from about 0% to about 6%, or from about 0% to about 2%.

The conjugation buffer can further comprise propylene glycol to facilitate solubility of the thiol-reactive compound in the conjugation buffer. Suitable concentrations of propylene glycol include from about 1% to about 50%, from about 20% to about 50%, from about 30% to about 50%, from about 40% to about 50%, from about 10% to about 40%, from about 10% to about 30%, or from about 10% to about 20%. In some embodiments, the concentration of propylene glycol can be about 1% or about 5%. In some embodiments, the concentration of propylene glycol can be about 10%. In some embodiments, the concentration of propylene glycol can be about 20%. In some embodiments, the concentration of propylene glycol can be about 30%. In some embodiments, the concentration of propylene glycol can be about 40%. In some embodiments, the concentration of propylene glycol can be about 50%.

The conjugation buffer can further comprise a non-ionic detergent to facilitate solubility of the conjugated immunoglobulin in the conjugation buffer. Exemplary non-ionic detergents include, but are not limited to, polysorbate-20 or polysorbate-80. Suitable concentrations of non-ionic detergent include from about 0% to about 1%, from about 0.1% to about 1%, from about 0.3% to about 1%, from about 0.5% to about 1%, from about 0.7% to about 1%, from about 0% to about 0.8%, from about 0% to about 0.6%, from about 0% to about 0.4%, or from about 0% to about 0.2%. In some embodiments, the concentration of non-ionic detergent can be about 0.1%. In some embodiments, the concentration of non-ionic detergent can be about 0.2%. In some embodiments, the concentration of non-ionic detergent can be about 0.3%. In some embodiments, the concentration of non-ionic detergent can be about 0.4%. In some embodiments, the concentration of non-ionic detergent can be about 0.5%. In some embodiments, the concentration of non-ionic detergent can be about 0.6%. In some embodiments, the concentration of non-ionic detergent can be about 0.7%. In some embodiments, the concentration of non-ionic detergent can be about 0.8%. In some embodiments, the concentration of non-ionic detergent can be about 0.9%. In some embodiments, the concentration of non-ionic detergent can be about 1.0%.

The contacting can be performed for about 30 minutes to about 48 hours, for about 1 hour to about 48 hours, for about 2 hours to about 24 hours, for about 24 hours to about 48 hours, for about 30 hours to about 48 hours, for about 36 hours to about 48 hours, for about 42 hours to about 48 hours, for about 2 hours to about 42 hours, for about 2 hours to about 36 hours, for about 2 hours to about 30 hours, for about 2 hours to about 24 hours, for about 2 hours to about 18 hours, for about 2 hours to about 12 hours, about 30 minutes to about 1 hour, about 30 minutes to about 2 hours, or for about 2 hours to about 6 hours. In some embodiments, the contacting can be performed for about 30 minutes. In some embodiments, the contacting can be performed for about 1 hour. In some embodiments, the contacting can be performed for about 1.5 hours. In some embodiments, the contacting can be performed for 2 hours. In some embodiments, the contacting can be performed for 6 hours. In some embodiments, the contacting can be performed for 12 hours. In some embodiments, the contacting can be performed for 18 hours. In some embodiments, the contacting can be performed for 24 hours. In some embodiments, the contacting can be performed for 30 hours. In some embodiments, the contacting can be performed for 36 hours. In some embodiments, the contacting can be performed for 42 hours. In some embodiments, the contacting can be performed for 48 hours.

The temperature of the contacting can be from about 4° C. to about 50° C., from about 18° C. to about 37° C., from about 20° C. to about 37° C., from about 22° C. to about 37° C., from about 24° C. to about 37° C., from about 26° C. to about 37° C., from about 28° C. to about 37° C., from about 30° C. to about 37° C., from about 32° C. to about 37° C., from about 34° C. to about 37° C., from about 18° C. to about 34° C., from about 18° C. to about 32° C., from about 18° C. to about 30° C., from about 18° C. to about 28° C., from about 18° C. to about 26° C., or from about 18° C. to about 24° C. In some embodiments, the contacting can be performed at 4° C. In some embodiments, the contacting can be performed at 18° C. In some embodiments, the contacting can be performed at 20° C. In some embodiments, the contacting can be performed at 22° C. In some embodiments, the contacting can be performed at 24° C. In some embodiments, the contacting can be performed at 26° C. In some embodiments, the contacting can be performed at 28° C. In some embodiments, the contacting can be performed at 30° C. In some embodiments, the contacting can be performed at 32° C. In some embodiments, the contacting can be performed at 34° C. In some embodiments, the contacting can be performed at 37° C. In some embodiments, the contacting can be performed at 50° C.

Unincorporated functional agent or acyl donor substrate can be separated from the conjugated immunoglobulin by desalting chromatography using a number of suitable resins including, but not limited to, G-25 resin, G-50 resin, Biogel P10, or other resins with exclusion limits of ranges 5,000-10,000 Da. Chromatography can be performed in column format or spin-column format, depending on scale. Suitable buffers for desalting include, for example, DPBS, 1×PBS, sodium phosphate, potassium phosphate, sodium borate, Tris, or HEPES-based buffers may substitute for 1×PBS.

In a first embodiment, the functional agent comprising an acyl donor substrate which comprises a glutamine residue conjugated to the engineered lysine residue via the acyl donor substrate. In this first embodiment, the functional agent is combined with the acyl donor substrate prior to conjugation with the immunoglobulin by reacting the reactive group on the acyl donor substrate with the functional agent. In a second embodiment, the acyl donor substrate comprising a glutamine residue and a reactive group is first conjugated to the immunoglobulin, and then the reactive group is joined to a functional agent.

The acyl donor substrates can comprise a linker, "L". Linkers can be non-cleavable linkers or cleavable linkers. Exemplary linkers include, for example, disulfide containing linkers, acetal-based linkers, and ketal-based linkers. In some aspects, the linker can be a non-cleavable linker. Suitable non-cleavable linkers include, but are not limited to, one or more amino acid, polyethylene glycol (PEG) or an alkyl. In some embodiments, the linker can comprise PEG. In some aspects, the linker can be a cleavable linker. Suitable cleavable linkers include, for example, valine-citrulline-para aminobenzyl. In some aspects, the linker can be a disulfide containing linker. In some aspects, the linker can be an acetal-based linker. In some aspects, the linker can be a ketal-based linker. A linker may also be one or more amino acids, alone or in combination with another linker such as one or more PEG groups.

The acyl donor substrate comprising a glutamine residue can be present in, part of, or attached to, a functional agent. Suitable functional agents include, for example, fluorophores, fluorescent dyes, polypeptides, immunoglobulins, antibiotics, nucleic acids, radionuclides, chemical linkers, small molecules, chelators, lipids, nucleic acids (such as DNA or RNA) and drugs. In some aspects, the functional agent can comprise a fluorophore. In some aspects, the functional agent can comprise a fluorescent dye. In some aspects, the functional agent can comprise a polypeptide. In some aspects, the functional agent can comprise an immunoglobulin. In some aspects, the functional agent can comprise an antibiotic. In some aspects, the functional agent can comprise a nucleic acid (such as DNA or RNA). In some aspects, the functional agent can comprise a radionuclide. In some aspects, the functional agent can comprise a small molecule. In some aspects, the functional agent can comprise a chelator (for example, DOTA, CHX-A"-DTPA, NOTA, among others). In some aspects, the functional agent can comprise a lipid. In some aspects, the functional agent can comprise a drug. In some aspects, the functional agent can comprise a combination of any of the above listed functional agents.

The acyl donor substrate (i.e., a first acyl donor substrate) can be bound to a second acyl donor substrate or linker, the second acyl donor substrate or linker being bound to a second immunoglobulin having a second heavy chain variable region and a second light chain variable region, the second heavy chain variable region having an engineered lysine residue. For example, the first acyl donor substrate and the second acyl donor substrate can have a first and second chemical linker as the first and second functional agents, respectively. The first and second chemical linkers can be bound to each other by a number of suitable means including, for example, by click chemistry.

In one embodiment, the functional agent comprising an acyl donor substrate is according to one of formulae (I) or (II):

$(Z)_m\text{-Gln-}(L)_n\text{-}(Y)$       (I)

$(Y)\text{-}(L)_n\text{-Gln-}(Z)_m$       (II)

wherein Z is a carboxylbenzyloxy (CBZ) group or an amino acid residue; Gln is a glutamine amino acid residue; each L is independently a straight or branched linker from 1 to 20 carbon atoms, wherein one or more of the carbon atoms may be optionally and independently replaced with a nitrogen, oxygen or sulfur atom, and wherein each carbon and nitrogen atom may be optionally substituted; or each L is optionally and independently an amino acid residue; m is an integer from 0 to 5; n is an integer from 0 to 5; and Y is a functional agent.

In another embodiment, the acyl donor substrate is according to one of formulae (III) or (IV):

$(Z)_m\text{-Gln-}(L)_n\text{-}(X)$       (III)

$(X)\text{-}(L)_n\text{-Gln-}(Z)_m$       (IV)

wherein

Z is a carboxylbenzyloxy (CBZ) group or an amino acid residue; Gln is a glutamine amino acid residue; each L is independently a straight or branched linker from 1 to 20 carbon atoms, wherein one or more of the carbon atoms may be optionally and independently replaced with a nitrogen, oxygen or sulfur atom, and wherein each carbon and nitrogen atom may be optionally substituted; or each L is optionally and independently an amino acid residue; m is an integer from 0 to 5; n is an integer from 0 to 5; and X is a reactive group.

In one embodiment, Z is a CBZ group. In another embodiment, Z is an amino acid residue.

In one embodiment, L is an amino acid residue. In one embodiment, n is 2-5, and each L is independently an amino acid residue. In another embodiment, L is a straight or branched linker from 1 to 20 carbon atoms, wherein one or more of the carbon atoms may be optionally and independently replaced with a nitrogen, oxygen or sulfur atom, and wherein each carbon and nitrogen atom may be optionally substituted. In another embodiment, L is a polyethylene glycol (PEG) moiety. In another embodiment, n is 2-5, and one or more L comprises one or more amino acids and one or more additional L groups comprises a polyethylene glycol moiety (PEG).

In one embodiment, m is 0. In another embodiment, m is 1. In another embodiment, m is 2. In another embodiment, m is 3. In another embodiment, m is 4. In another embodiment, m is 5.

In one embodiment, n is 0. In another embodiment, n is 1. In another embodiment, n is 2. In another embodiment, n is 3. In another embodiment, n is 4. In another embodiment, n is 5.

In one embodiment, X is (1R,8S,9s)-bicyclo[6.1.0]non-4-yn-9-ylmethanol (BCN). In another embodiment, X is

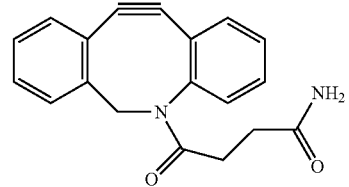 [SMILES: NC(=O)CCC(=O)N1Cc2ccccc2C#Cc2ccccc21]

(dibenzocyclooctyne; DBCO). In another embodiment, X is trans-cyclooctene (TCO). In another embodiment, X is azido ($N_3$). In another embodiment, X is alkyne. In another embodiment, X is tetrazine methylcyclopropene. In another embodiment, X is norbornene. In another embodiment, X is hydrazide/hydrazine. In another embodiment, X is aldehyde.

In one embodiment, for an acyl donor substrate according to formula (I), Z is a CBZ group; L is a polyethylene glycol moiety (PEG) (—O(($CH_2$)$_2$)—), ethyl amine (—NH(($CH_2$)$_2$)—) or propyl amine (—NH(($CH_2$)$_3$)—); and n is 0, 1, 2 or 3.

In another embodiment, the acyl donor substrate is according to formula (I), wherein Z is a CBZ group, and L is an amino acid. In one embodiment, L is Gly. In one aspect of this embodiment, m is 1, and n is 1.

In one embodiment, the acyl donor substrate is according to formula (II), wherein Z is a CBZ group; m is 1; n is 1, 2 or 3; and at least one Lisa Gly.

In another embodiment, the functional agent Y is auristatin F.

In one embodiment, for an acyl donor substrate according to formula (III), Z is a CBZ group; L is a polyethylene glycol moiety (PEG) (—O(($CH_2$)$_2$)—), ethyl amine (—NH(($CH_2$)$_2$)—) or propyl amine (—NH(($CH_2$)$_3$)—); and n is 0, 1, 2 or 3.

In another embodiment, the acyl donor substrate is according to formula (III), wherein Z is a CBZ group, and L is an amino acid. In one embodiment, L is Gly. In one aspect of this embodiment, m is 1, and n is 1.

In one embodiment, the acyl donor substrate is according to formula (IV), wherein Z is a CBZ group; m is 1; n is 1, 2 or 3; and at least one L is a Gly. In another embodiment, the functional agent Y is auristatin F.

The disclosed methods can be performed on a humanized immunoglobulin, or antigen-binding portion thereof. Thus, in some embodiments, the immunoglobulin, or antigen-binding portion thereof can be a humanized immunoglobulin, or antigen-binding portion thereof.

The disclosed methods can be performed on a human immunoglobulin, or antigen-binding portion thereof. Thus, in some embodiments, the immunoglobulin, or antigen-binding portion thereof can be a human immunoglobulin, or antigen-binding portion thereof. In another embodiment, the immunoglobulin, or antigen-binding portion thereof can be a non-human immunoglobulin, or antigen-binding portion thereof.

In one embodiment, the disclosed methods can be performed on an $IgG_1$, $IgG_2$, $IgG_3$ or $IgG_4$ immunoglobulin, or antigen-binding portion thereof. In one embodiment, the method is performed on an $IgG_1$ immunoglobulin, or antigen-binding portion thereof. In one embodiment, the method is performed on an $IgG_2$ immunoglobulin, or antigen-binding portion thereof. In one embodiment, the method is performed on an $IgG_3$ immunoglobulin, or antigen-binding portion thereof. In one embodiment, the method is performed on an $IgG_4$ immunoglobulin, or antigen-binding portion thereof.

In one embodiment, the disclosed methods can be performed on an $IgA_1$, $IgA_2$, or IgM immunoglobulin, or antigen-binding portion thereof. In one embodiment, the method is performed on an $IgA_1$ immunoglobulin, or antigen-binding portion thereof. In one embodiment, the method is performed on an $IgA_2$ immunoglobulin, or antigen-binding portion thereof. In one embodiment, the method is performed on an IgM immunoglobulin, or antigen-binding portion thereof. In one embodiment, the IgA or IgM immunoglobulin, or antigen-binding portion thereof has a tail piece. In another embodiment, the IgA or IgM immunoglobulin, or antigen-binding portion thereof has the tail piece removed.

In one embodiment, the method is performed on an IgD or IgE immunoglobulin, or antigen-binding portion thereof. In one embodiment, the method is performed on an IgD immunoglobulin, or antigen-binding portion thereof. In one embodiment, the method is performed on an IgE immunoglobulin, or antigen-binding portion thereof.

For the methods described herein, in one embodiment, the microbial transglutaminase is from Actinomadura sp. T-2, Bacillus circulans BL32, Bacillus subtilis spores, Corynebacterium ammoniagenes, Corynebacterium glutamicum, Enterobacter sp. C2361, Providencia sp. C1112, Streptoverticillium mobaraense (aka Streptomyces mobaraensis), Streptomyces platensis M5218, Streptomyces hygroscopicus, Streptomyces lividans, Streptomyces lividans JT46/pAE053, Streptomyces lydicus, Streptomyces platensis, Streptomyces sioyansis, Streptoverticillium griseocarneum, Streptoverticillium ladakanum NRRL-3191, Streptoverticillium sp. s-8112, or Streptococcus suis. In one embodiment, the microbial transglutaminase is from Streptomyces mobaraensis.

For the methods described herein, in one embodiment, the transglutaminase is isolated from a plant selected from the group consisting of Medicago sativa, Beta vulgaris, Helianthus tuberosus, Zea mays, Glycine max, Arabidopsis thaliana, Nicotiana tabacum, Chlamydomonas reinhardtii, Dunaliella salina, Oryza sativa, and Rosmarinus officinalis L.

For the methods described herein, in one embodiment, the transglutaminase is mammalian and is isolated from Transglutaminase 1 thru 7 and Factor XIII In one embodiment, the transglutaminase is at least 75%, 80%, 81%, 82%, 83%, 84%, 85%, 86%, 87%, 88%, 89%, 90%, 91%, 92%, 93%, 94%, 95%, 96%, 97%, 98%, or 99% identical to a microbial transglutaminase described herein. In one embodiment, the transglutaminase is at least 75%, 80%, 81%, 82%, 83%, 84%, 85%, 86%, 87%, 88%, 89%, 90%, 91%, 92%, 93%, 94%, 95%, 96%, 97%, 98%, or 99% identical to the microbial transglutaminase is from Streptomyces mobaraensis. Transglutaminase enzymes can be purchased from Ajinomoto® or Zedira (Product number T001). In another embodiment, the transglutaminase is purified. In another embodiment, the transglutaminase is recombinantly expressed and subsequently purified using methods known to one of ordinary skill in the art.

In one embodiment, the transglutaminase enzyme is present in the methods described herein in a concentration of about 0.1 units/mL to about 250 units/mL. In one embodiment, the transglutaminase enzyme is present in the methods described herein in a concentration of about 1 unit/mL to about 25 units/mL. In one embodiment, the transglutaminase enzyme is present in the methods described herein in a concentration of about 1 unit/mL to about 25 units/mL. In one embodiment, the transglutaminase enzyme is present in the methods described herein in a concentration of about 0.1 unit/mL. In one embodiment, the transglutaminase enzyme is present in the methods described herein in a concentration of about 0.5 unit/mL. In one embodiment, the transglutaminase enzyme is present in the methods described herein in a concentration of about 1 unit/mL. In one embodiment, the transglutaminase enzyme is present in the methods described herein in a concentration of about 5 units/mL. In one embodiment, the transglutaminase enzyme is present in the methods described herein in a concentration of about 10 units/mL. In one embodiment, the transglutaminase enzyme is present in the methods described herein in a concentration of about 15 units/mL. In one embodiment, the transglutaminase enzyme is present in the methods described herein in a concentration of about 20 units/mL. In one embodiment, the transglutaminase enzyme is present in the methods described herein in a concentration of about 25 units/mL. In one embodiment, the transglutaminase enzyme is present in the methods described herein in a concentration of about 50 units/mL. In one embodiment, the transglutaminase enzyme is present in the methods described herein in a concentration of about 75 units/mL. In one embodiment, the transglutaminase enzyme is present in the methods described herein in a concentration of about 100 units/mL. In one embodiment, the transglutaminase enzyme is present in the methods described herein in a concentration of about 150 units/mL, 200 units/mL, or 250 units/mL.

For the methods provided herein, in one embodiment, the ratio of functional agent to immunoglobulin is from about 1:1 to about 200:1. In one embodiment, the ratio of functional agent to immunoglobulin is from about 1:1 to about 100:1. In one embodiment, the ratio of functional agent to immunoglobulin is from about 1:1 to about 25:1. In one embodiment, the ratio of functional agent to immunoglobulin is from about 1:1 to about 20:1. In one embodiment, the ratio of functional agent to immunoglobulin is from about 1:1 to about 15:1. In one embodiment, the ratio of functional agent to immunoglobulin is from about 1:1 to about 10:1. In one embodiment, the ratio of functional agent to immunoglobulin is from about 1:1 to about 9:1. In one embodiment, the ratio of functional agent to immunoglobulin is from about 1:1 to about 8:1. In one embodiment, the ratio of functional agent to immunoglobulin is from about 1:1 to about 7:1. In one embodiment, the ratio of functional agent to immunoglobulin is from about 1:1 to about 6:1. In one embodiment, the ratio of functional agent to immunoglobulin is from about 1:1 to about 5:1. In one embodiment, the ratio of functional agent to immunoglobulin is from about 1:1 to about 4:1. In one embodiment, the ratio of functional agent to immunoglobulin is from about 1:1 to about 3:1. In one embodiment, the ratio of functional agent to immunoglobulin is from about 1:1 to about 2:1. In one embodiment, the ratio of functional agent to immunoglobulin is about 1:1. In one embodiment, the ratio of functional agent to immunoglobulin is from about 10:1 to about 100:1. In one embodiment, the ratio of functional agent to immunoglobulin is from about 50:1 to about 200:1. In one embodiment, the ratio of functional agent to immunoglobulin is from about 1:1 to about 50:1. In one embodiment, the ratio of functional agent to immunoglobulin is from about 1:1 to about 100:1. In one embodiment, the ratio of functional agent to immunoglobulin is from about 1:1 to about 150:1. In one embodiment, the ratio of functional agent to immunoglobulin is from about 50:1 to about 100:1. In one embodiment, the ratio of functional agent to immunoglobulin is from about 100:1 to about 200:1.

In one embodiment, the ratio of functional agent to immunoglobulin is about 20:1. In one embodiment, the ratio of functional agent to immunoglobulin is known and is consistently reproducible by following the methods disclosed herein. In some embodiments, the ratio of a functional agent:immunoglobulin is about 1:1. In some embodiments, the ratio of a functional agent:immunoglobulin is about 2:1. In some embodiments, the ratio of a functional agent:immunoglobulin is about 3:1. In some embodiments, the ratio of a functional agent:immunoglobulin is about 4:1. In some embodiments, the ratio of a functional agent:immunoglobulin is about 5:1. In some embodiments, the ratio of a functional agent:immunoglobulin is about 6:1. In some embodiments, the ratio of a functional agent:immunoglobulin is about 7:1. In some embodiments, the ratio of a functional agent:immunoglobulin is about 8:1. In some embodiments, the ratio of a functional agent:immunoglobulin is about 9:1. In some embodiments, the ratio of a functional agent:immunoglobulin is about 10:1. In some embodiments, the ratio of a functional agent:immunoglobulin is about 11:1. In some embodiments, the ratio of a functional agent:immunoglobulin is about 12:1. In some embodiments, the ratio of a functional agent:immunoglobulin is about 13:1. In some embodiments, the ratio of a functional agent:immunoglobulin is about 14:1. In some embodiments, the ratio of a functional agent:immunoglobulin is about 15:1. In some embodiments, the ratio of a functional agent:immunoglobulin is about 16:1. In some embodiments, the ratio of a functional agent:immunoglobulin is about 17:1. In some embodiments, the ratio of a functional agent:immunoglobulin is about 18:1. In some embodiments, the ratio of a functional agent:immunoglobulin is about 19:1. In some embodiments, the ratio of a functional agent:immunoglobulin is about 20:1. The ratio of functional agent to immunoglobulin, as used herein, is calculated based on an average of the conjugation ratio of the functional agent to an immunoglobulin in a pool of antibodies in a composition.

In embodiments of the present invention, acyl acceptor sites are engineered in a immunoglobulin, or antigen-binding portion thereof, by either insertion of a lysine between two natural amino acid residues, or by a the substitution of a natural amino acid with lysine substitution. Engineered lysine residues may be located at one or more positions throughout the sequence of an immunoglobulin. The optimal context for an acyl acceptor site is not only position-dependent, but also requires that the amino acid residue adjacent to and immediately before the engineered lysine not be an acidic amino acid residue; and that the amino acid residue adjacent to and immediately after the engineered lysine not be an acidic amino acid residue or a proline residue. MTGase conjugation technology can utilize these engineered sites to conjugate a variety of acyl donor-containing functional agents for making antibody drug conjugates (ADCs), bispecific antibodies, immunotoxins, or other mAb-protein complexes. In another embodiment, combining multiple engineered acyl acceptor sites, the theoretical drug-to-antibody ratio (DAR) increases for each engineered acyl acceptor site. Increasing the DAR of an ADC results in delivery of more functional agents into a subject per monoclonal antibody, which allows for defined DARs, better product homogeneity, and lower patient dosing.

In embodiments provided herein, wherein at least two additional engineered lysine residues are present, the ratio of functional agent to immunoglobulin is increased based on the number of additional engineered lysine residues. For example, wherein two engineered lysine residues are present, resulting in an antibody with four transamidation sites and a ratio of functional agent to immunoglobulin of about 2:1 to about 4:1. As another example, wherein three engineered lysine residues are present, resulting in an antibody with six transamidation sites and a ratio of functional agent to immunoglobulin of about 2:1 to about 6:1.

Conjugated Immunoglobulins

Also disclosed herein are conjugated immunoglobulins comprising any of the immunoglobulins or antigen-binding portions thereof disclosed herein, wherein the engineered lysine residue is a lysine residue insertion or a natural amino acid residue which has been mutated to a lysine residue, and is conjugated to a functional agent comprising an acyl donor substrate, wherein the acyl donor substrate comprises a glutamine residue. Additional embodiments include conjugated immunoglobulins comprising any of the immunoglobulins or antigen-binding portions thereof disclosed herein, wherein the engineered lysine residue is a lysine residue insertion or a natural amino acid residue which has been mutated to a lysine residue, and is conjugated to an acyl donor substrate, wherein the acyl donor substrate comprises a glutamine residue and a reactive group, wherein the reactive group can be reacted with a functional agent after the conjugation of the acyl donor substrate to the immunoglobulin, or antigen-binding portion thereof.

In one embodiment, the amino acid residues flanking the engineered lysine are also engineered, e.g., mutated to optimize the sequence for an engineered acyl acceptor lysine site on an immunoglobulin. For example, the amino acid residue adjacent to and immediately after the engineered lysine residue (e g, amino acid position +1) may be mutated to any amino acid residue other than proline or an acidic amino acid residue. The amino acid residue adjacent to and immediately before the engineered lysine residue (e.g., amino acid position −1) may be mutated to any amino acid residue other than an acidic amino acid residue.

In one embodiment, the amino acid residue adjacent to and immediately after the engineered lysine (amino acid position +1) may be mutated to lysine, arginine, histidine, serine, threonine, asparagine, glutamine, cysteine, glycine, alanine, valine, isoleucine, leucine, methionine, phenylalanine, tyrosine, or tryptophan. In one embodiment, the mutated amino acid residue adjacent to and immediately after the engineered lysine (amino acid position +1) is glycine. In one embodiment, the mutated amino acid residue adjacent to and immediately after the engineered lysine (amino acid position +1) is lysine. In one embodiment, the mutated amino acid residue adjacent to and immediately after the engineered lysine (amino acid position +1) is alanine. In one embodiment, the mutated amino acid residue adjacent to and immediately after the engineered lysine (amino acid position +1) is valine. In one embodiment, the mutated amino acid residue adjacent to and immediately after the engineered lysine (amino acid position +1) is leucine. In one embodiment, the mutated amino acid residue adjacent to and immediately after the engineered lysine (amino acid position +1) is isoleucine. In one embodiment, the mutated amino acid residue adjacent to and immediately after to the engineered lysine (amino acid position +1) is methionine. In one embodiment, the mutated amino acid residue adjacent to and immediately after the engineered lysine (amino acid position +1) is phenylalanine. In one embodiment, the mutated amino acid residue adjacent to and immediately after the engineered lysine (amino acid position +1) is tyrosine. In one embodiment, the mutated amino acid residue adjacent to and immediately after the engineered lysine (amino acid position +1) is tryptophan. In one embodiment, the mutated amino acid residue adjacent to and immediately after the engineered lysine (amino acid position +1) is serine. In one embodiment, the mutated amino acid residue adjacent to and immediately after the engineered lysine (amino acid position +1) is threonine. In one embodiment, the mutated amino acid residue adjacent to and immediately after the engineered lysine (amino acid position +1) is cysteine. In one embodiment, the mutated amino acid residue adjacent to and immediately after the engineered lysine (amino acid position +1) is asparagine. In one embodiment, the mutated amino acid residue adjacent to and immediately after the engineered lysine (amino acid position +1) is glutamine. In one embodiment, the mutated amino acid residue adjacent to and immediately after the engineered lysine (amino acid position +1) is histidine. In one embodiment, the mutated amino acid residue adjacent to and immediately after the engineered lysine (amino acid position +1) is arginine. In one embodiment, wherein the amino acid residue adjacent to and immediately after the engineered lysine (amino acid position +1) is not proline, aspartic acid, or glutamic acid.

In one embodiment, the amino acid residue adjacent to and immediately before the engineered lysine (amino acid position −1) may be mutated to lysine, arginine, histidine, serine, threonine, asparagine, glutamine, cysteine, glycine, proline, alanine, valine, isoleucine, leucine, methionine, phenylalanine, tyrosine, or tryptophan. In one embodiment, the mutated amino acid residue adjacent to and immediately before the engineered lysine (amino acid position −1) is glycine. In one embodiment, the mutated amino acid residue adjacent to and immediately before the engineered lysine (amino acid position −1) is lysine. In one embodiment, the mutated amino acid residue adjacent to and immediately before the engineered lysine (amino acid position −1) is alanine. In one embodiment, the mutated amino acid residue adjacent to and immediately before the engineered lysine (amino acid position −1) is valine. In one embodiment, the mutated amino acid residue adjacent to and immediately before the engineered lysine (amino acid position −1) is leucine. In one embodiment, the mutated amino acid residue adjacent to and immediately before the engineered lysine (amino acid position −1) is isoleucine. In one embodiment, the mutated amino acid residue adjacent to and immediately before the engineered lysine (amino acid position −1) is methionine. In one embodiment, the mutated amino acid residue adjacent to and immediately before the engineered lysine (amino acid position −1) is phenylalanine. In one embodiment, the mutated amino acid residue adjacent to and immediately before the engineered lysine (amino acid position −1) is tyrosine. In one embodiment, the mutated amino acid residue adjacent to and immediately before the engineered lysine (amino acid position −1) is tryptophan. In one embodiment, the mutated amino acid residue adjacent to and immediately before the engineered lysine (amino acid position −1) is serine. In one embodiment, the mutated amino acid residue adjacent to and immediately before the engineered lysine (amino acid position −1) is threonine. In one embodiment, the mutated amino acid residue adjacent to and immediately before the engineered lysine (amino acid position −1) is cysteine. In one embodiment, the mutated amino acid residue adjacent to and immediately before the engineered lysine (amino acid position −1) is asparagine. In one embodiment, the mutated amino acid residue adjacent to and immediately before the engineered lysine (amino acid position −1) is glutamine. In one embodiment, the mutated amino acid residue adjacent to and immediately before the engineered lysine (amino acid position −1) is histidine. In one embodiment, the mutated amino acid residue adjacent to and immediately before the engineered lysine (amino acid position −1) is proline. In one embodiment, the mutated amino acid residue adjacent to and immediately before the engineered lysine (amino acid position −1) is arginine. In one embodiment, wherein the amino acid residue adjacent to and immediately before the engineered lysine (amino acid position +1) is not aspartic acid or glutamic acid.

In some embodiments, the immunoglobulin can be humanized. In other embodiments, the immunoglobulin is human. In another embodiment, the immunoglobulin is chimeric.

The acyl donor substrate comprising a glutamine residue and a reactive group can also comprise a linker, "L". Likewise, the functional agents which contain an acyl donor substrate comprising a glutamine residue can have a linker between the functional agent and the acyl donor substrate portion of the molecule. Linkers can be non-cleavable linkers or cleavable linkers. Exemplary linkers include, for example, disulfide containing linkers, acetal-based linkers, and ketal-based linkers. In some aspects, the linker can be a non-cleavable linker. Suitable non-cleavable linkers include, but are not limited to, polyethylene glycol (PEG) or an alkyl. In some embodiments, the linker can comprise PEG. In some aspects, the linker can be a cleavable linker. Suitable cleavable linkers include, for example, valine-citrulline-para aminobenzyl. In some aspects, the linker can be a disulfide containing linker. In some aspects, the linker can be an acetal-based linker. In some aspects, the linker can be a ketal-based linker.

The conjugated immunoglobulins of the invention comprise a functional agent. Suitable functional agents include, for example, a therapeutic agent or a diagnostic agent. Suitable functional agents include, for example, fluorophores, fluorescent dyes, polypeptides, immunoglobulins, antibiotics, nucleic acids, radionuclides, chemical linkers, small molecules, chelators, lipids, and drugs. In some aspects, the functional agent can comprise a fluorophore. In some aspects, the functional agent can comprise a fluorescent dye. In some aspects, the functional agent can comprise a polypeptide. In some aspects, the functional agent can comprise an immunoglobulin. In some aspects, the functional agent can comprise an antibiotic. In some aspects, the functional agent can comprise a nucleic acid (such as DNA or RNA). In some aspects, the functional agent can comprise a radionuclide. In some aspects, the functional agent can comprise a small molecule. In some aspects, the functional agent can comprise a chelator (for example, DOTA, CHX-A"-DTPA, NOTA, among others). In some aspects, the functional agent can comprise a lipid. In some aspects, the functional agent can comprise a drug. In some aspects, the functional agent can comprise a combination of any of the above listed functional agents.

Accordingly, the disclosed conjugated immunoglobulins include, but are not limited to, immunoglobulin-fluorophore conjugates, immunoglobulin-fluorescent dye conjugates, immunoglobulin-polypeptide conjugates, immunoglobulin-immunoglobulin conjugates, immunoglobulin-antibiotic conjugates, immunoglobulin-nucleic acid conjugates, immunoglobulin-radionuclide conjugates, immunoglobulin-chemical linker conjugates, immunoglobulin-small molecule conjugates, immunoglobulin-chelator conjugates, immunoglobulin-lipid conjugates, and immunoglobulin-drug conjugates.

Any of the immunoglobulins disclosed herein can be conjugated to any of the functional agents disclosed herein. For example, the conjugated immunoglobulin can comprise a fluorophore, fluorescent dye, polypeptide, immunoglobulin, antibiotic, nucleic acid, radionuclide, chemical linker, small molecule, chelator, lipid, or drug.

In some embodiments, the immunoglobulin can be conjugated to a small molecule antineoplastic agent, such as an auristatin. In some aspects, the functional agent can be auristatin F (AuF). Thus, the disclosed conjugated immunoglobulins include any of the above disclosed immunoglobulins conjugated to auristatin F (AuF-T135K conjugate).

Pharmaceutical Compositions

Also provided herein are pharmaceutical compositions. In some embodiments, the pharmaceutical compositions can comprise any of the immunoglobulins disclosed herein. In some embodiments, the pharmaceutical compositions can comprise any of the conjugated immunoglobulins disclosed herein. In one embodiment, the pharmaceutical composition comprises the conjugated immunoglobulin and a pharmaceutically acceptable carrier.

Nucleic Acid Molecules Encoding Conjugatable Immunoglobulins and Host Cells Comprising the Same Also provided herein are nucleic acid molecules encoding any of the conjugatable immunoglobulins or antigen-binding portions thereof disclosed herein. As an example, in one embodiment, the nucleic acid molecule encodes a conjugatable immunoglobulin comprising a heavy chain variable region and a light chain variable region and wherein the encoded conjugatable immunoglobulin comprises an engineered lysine residue, and wherein the engineered lysine residue is a lysine residue insertion or a natural amino acid residue which has been mutated to a lysine residue. The engineered lysine residue of the immunoglobulin or antigen-binding portions thereof, is conjugated to the glutamine residue of an acyl donor substrate, thereby generating the conjugated immunoglobulin.

Also disclosed are host cells comprising any of the disclosed nucleic acid molecules or plasmids that encode the conjugatable immunoglobulin or antigen-binding portions thereof. Suitable host cells include, but are not limited to, mammalian cells, bacterial cells, yeast cells, insect cells, to name a few.

The following examples are provided to further describe some of the embodiments disclosed herein. The examples are intended to illustrate, not to limit, the disclosed embodiments.

EXAMPLES

Example 1: Materials & Methods

Site-Directed Mutagenesis

Mutations were generated using Stratagene's QuikChange XL according to the manufacturer's protocol. The desired mutations were confirmed by DNA sequencing.

Deletion Mutagenesis

HC fragments for Fab expression were made by PCR amplifying the HC leader sequence through the hinge that terminated at various 3' codons. The PCR fragments were cloned into a pcDNA3.1-based mammalian expression plasmid using an In-Fusion HD cloning kit according to the manufacturer's protocol (CLONTECH).

Transfection and Stable Cell Line Generation

For each milliliter of cells to be transfected with Expi-Fectamine, 333.3 ng HC plasmid and 333.3 ng LC plasmid was contacted for 5-10 min in 50 µL Opti-MEM (ThermoFisher Scientific, Waltham, Mass.). Likewise, 2.67 µL ExpiFectamine was contacted in 50 µL Opti-MEM. The ExpiFectamine solution was added to the DNA mixture, and incubated for 20-30 min at room temperature. The DNA:ExpiFectamine mixture was added to the cells while swirling and incubated at 37° C., 8% $CO_2$, shaking at 125 rpm. The following day, 5 µL of enhancer 1 and 50 µL of enhancer 2 per mL of cells were added to the transfection with continued incubation for another 7-10 days.

Antibody-expressing stable pools were selected by adding 1 mL of transfectants to 14 mL DMEM in a T75 flask with 5 µg/mL blasticidin and 400 µg/mL zeocin (Invivogen, San Diego, Calif.) one to three days after transfection. After drug-resistant cells grew to confluency, the medium was replaced with FreeStyle 293 expression medium for 24 to 48 h. Cells were physically dislodged by tapping the flask (trypsinization resulted in low viability, data not shown) and were then seeded at $6 \times 10^5$ cells/mL in 30 mL FreeStyle 293 expression medium in a 125-mL shake flask. Cultures were incubated at 37° C. in 8% $CO_2$ with shaking at 125 rpm.

MAb and Fab Production

Stably-transfected cell line pools were seeded at 0.6 to $1 \times 10^6$ cells/mL in FreeStyle 293 expression medium. Cells were incubated at 37° C., 8% $CO_2$, shaking at 125 rpm. Two days after the culture reached a density of $1 \times 10^6$ cells/mL, cultures were fed with final concentrations of 10 g/L Select Soytone (BD Biosciences, San Jose, Calif.), 5 mM valeric acid (Sigma Aldrich, St. Louis, Mo.), and 1:100 CD Lipid Concentrate (ThermoFisher Scientific, Waltham, Mass.). When the cell viability was less than 50% (7-10 days), the cultures were centrifuged for 1 h at 8000 rpm in a Beckman JLA8.1000 rotor. The supernatant was then filtered through a 0.2 µm PES filter and stored at 4° C. or −20° C. until purification.

MAb and Fab Purification

MAbs were purified using one of two methods. For mAb and Fab supernatants less than 10 mL, affinity chromatography was performed using a batch purification method with protein A resin or anti-kappa resin, respectively. MAb and Fab supernatants greater than 25 mL were purified using pre-packed protein A or anti-kappa columns, respectively.

Batch Purification

Prosep-vA High Capacity Protein A resin (Millipore, Billerica, Mass.) was equilibrated with DPBS, and 100 µL were added to 3 to 6 mL of sample. Following incubation at 4° C. for 1 hour to overnight, the resin was washed three times with 1 mL DPBS and centrifuged at 18,000×g for 30 s. The sample was eluted from the resin by addition of 400 µL 0.1 M Glycine, pH 2.9 followed by centrifugation at 18,000×g for 30 s. The sample was neutralized with 40 µL of 1 M Tris, pH 8.0. The buffer was exchanged using 0.5 mL Amicon Ultra, 10 k cutoff filters (Millipore, Billerica, Mass.) by concentrating the sample to 100 µL by centrifugation at 18,000×g for 3 to 5 minutes. The concentrated sample was diluted in 400 µL DPBS, followed by centrifugation. The process was repeated a total of four times.

Column Purification

A protein A or HiTrap KappaSelect column (GE Healthcare, Little Chalfont, UK) was equilibrated with 10 column volumes (CV) of 20 mM sodium phosphate, 10 mM EDTA, pH 7.2. The sample was then loaded, followed by washing unbound material with 10 CV of equilibration buffer. The sample was eluted using 5 CV of 0.1 M Glycine, pH 2.9. The fractions containing the mAb were pooled and dialyzed in DPBS using a MWCO 20K Slide-A-Lyzer (ThermoFisher Scientific, Waltham, Mass.).

Z-Gln-Gly Substrate Synthesis

Z-Gln-Gly was purchased from Bachem, and Z-Gln-Gly-CAD-biotin was purchased from ZEDIRA (FIG. 2).

Z-Gln-Gly-pentafluorophenyl ester (Z-Gln-Gly-PFP)

Figure 3:
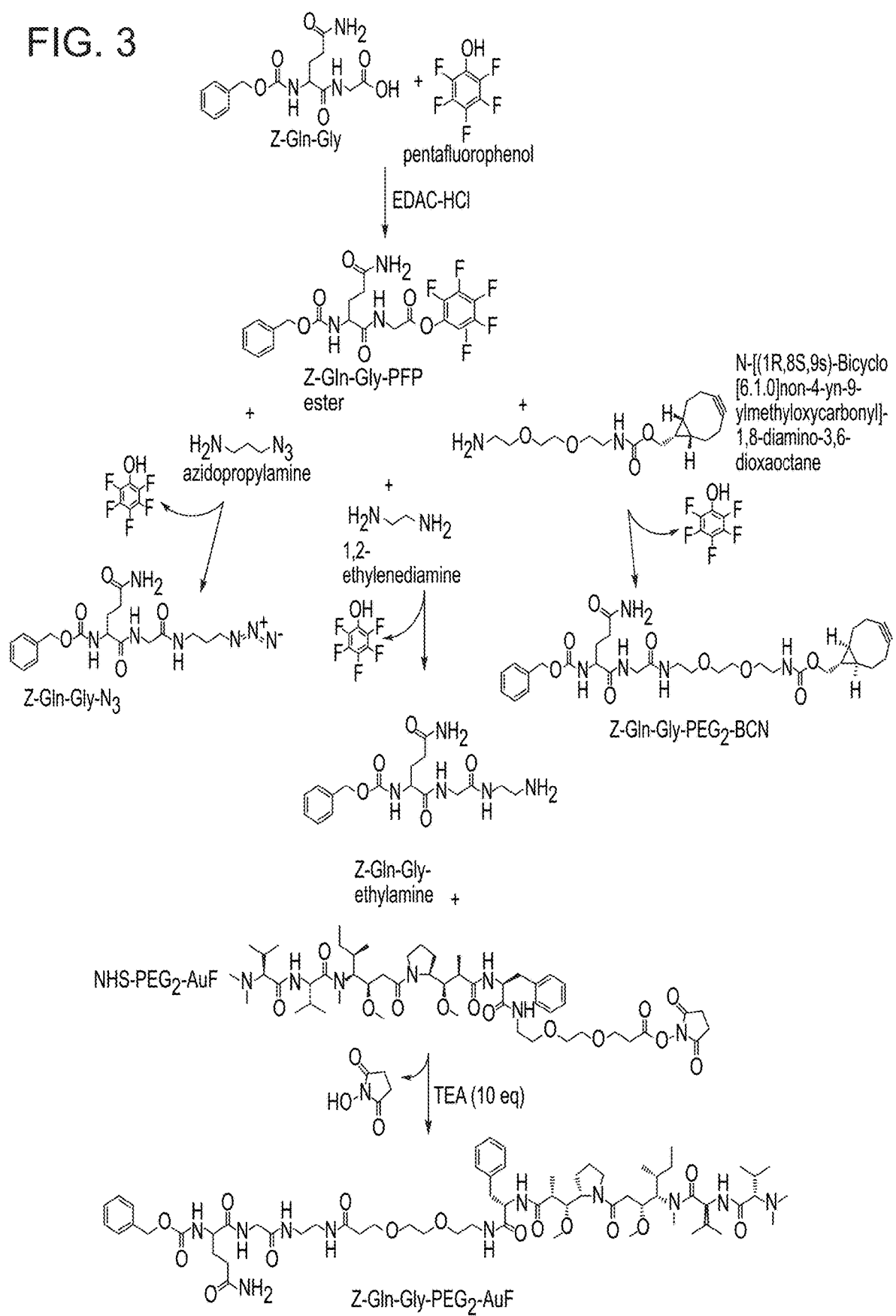
FIG. 3 shows possible routes to synthesize exemplary Z-Gln-Gly acyl-donor substrates.
Figure 5:
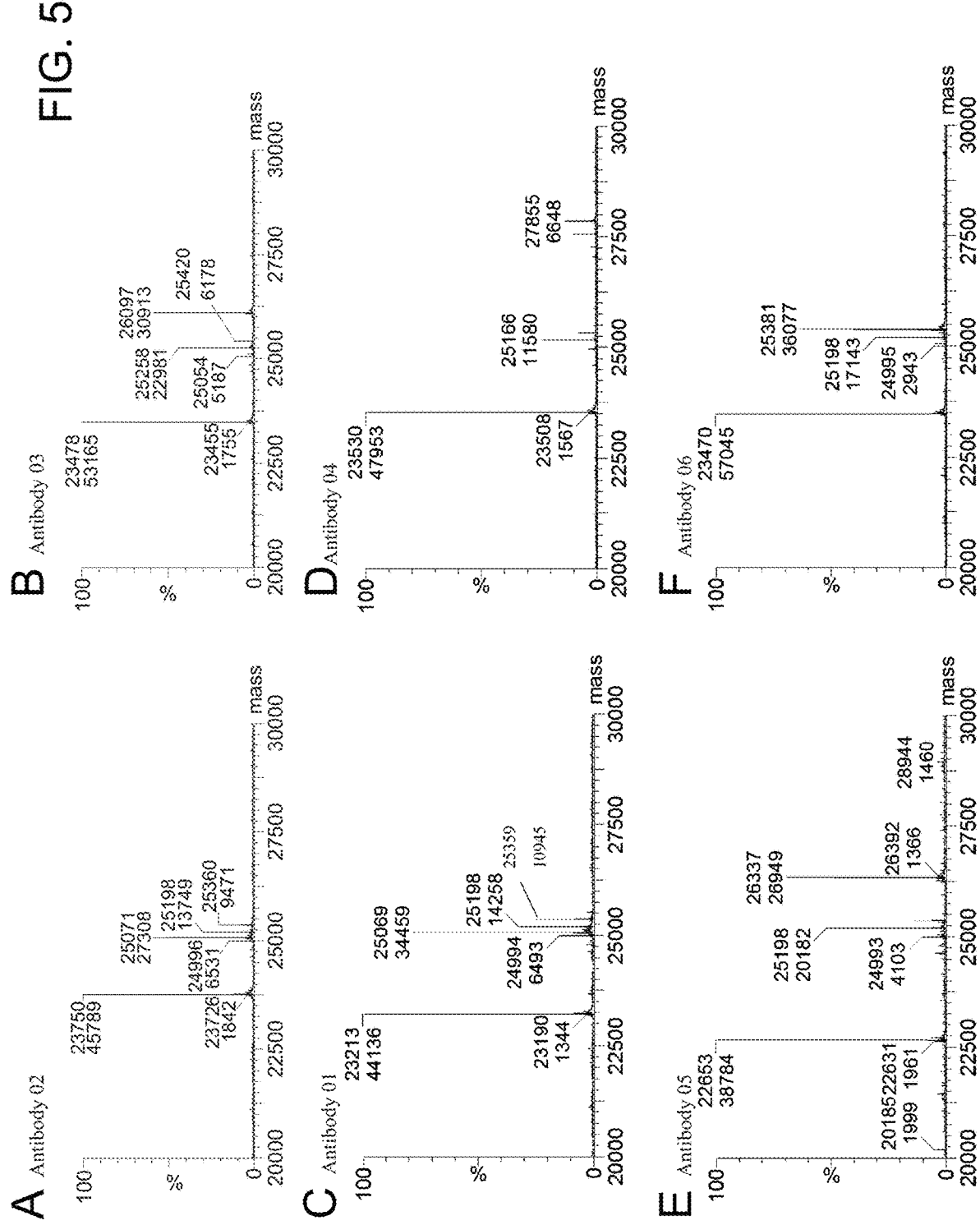
FIG. 5, Panels A, B, C, D, E, and F, show ESI-MS analysis of antibodies contacted with an acyl donor and microbial transglutaminase. Antibodies were contacted with 50-fold molar excess Z-Gln-Gly-CAD-biotin and 1 U/mL microbial transglutaminase overnight at 37° C. Following IdeS digestion and reduction, the LC, Fd, and Fc masses were determined by ESI-MS.

Synthesis was as described by Pasternack (Pasternack et al. 1997), with modifications (FIG. 3). Z-Gln-Gly (328.8 mg, 0.975 mmol) and pentafluorophenol (Sigma, 183.3 mg, 0.996 mmol) were dissolved in 10 mL NN'-dimethylformamide (DMF). EDAC-HCl (Sigma, 201 mg, 1.04 mmol) was then added and the reaction was incubated at room temperature under $N_2$ for 2 hr. 100 mL of cold diethyl ether was added to the reaction and precipitated overnight at −80° C. The crude product was collected by centrifugation and re-crystallized from 20 mL 60° C. methanol. The final product was rinsed with cold diethyl ether and dried over a stream of $N_2$. Final yield was 219.04 mg (44.7%). Electrospray ionization-mass spectrometry (ESI-MS) (direct infusion in 50% acetonitrile in 0.1% formic acid) m/z 504.0 ([M+H], 86%), 526.0 ([M+Na], 100%), 542.0 ([M+K], 22%).

Z-Gln-Gly-propyl azide (Z-Gln-Gly-$N_3$)

Z-Gln-Gly-PFP (21.24 mg, $4.22 \times 10^{-5}$ mol) and azidopropylamine (Click Chemistry Tools, 42.2 µL of a 0.91 M stock solution in DMF, $3.84 \times 10^{-5}$ mol) were dissolved in 0.42 mL final volume of DMF. Reaction was stirred under $N_2$ overnight at room temperature. Product was purified by HPLC using a 0.1% formic acid in $H_2O$/0.1% formic acid in acetonitrile mobile phase. Product was dried in vacuo. Final yield was 10.7 mg (60.4%). ESI-MS (gradient purification) m/z 420.2 ([M+H], 100%), 442.1 ([M+Na], 32%).

Z-Gln-Gly-PEG$_2$-bicyclononyne (Z-Gln-Gly-PEG$_2$-BCN)

Z-Gln-Gly-PFP (18.4 mg, $3.66 \times 10^{-5}$ mol) and N-[(1R,8S,9s)-Bicyclo[6.1.0]non-4-yn-9-ylmethyloxycarbonyl]-1,8-diamino-3,6-dioxaoctane (Sigma Aldrich) were dissolved in 0.37 mL final volume of DMF. Reaction was stirred under $N_2$ overnight at room temperature. Product was purified by HPLC using a 0.1% formic acid in $H_2O$/0.1% formic acid in acetonitrile mobile phase. Product was dried in vacuo. Final yield was 0.6 mg (2%). ESI-MS (gradient purification) m/z 688.2 ([M+H], 100%), 710.2 ([M+Na], 69%).

Z-Gln-Gly-PEG$_2$-Auristatin F (Z-Gln-Gly-PEG$_2$-AuF)

Z-Gln-Gly-PFP (22.2 mg, $4.37 \times 10^{-5}$ mol) was dissolved in 0.85 mL DMF and 1,2-ethylenediamine ($2.3 \times 10^{-5}$ L, $3.5 \times 10^{-4}$ mol) was added and mixed. Reaction was stirred under $N_2$ overnight at room temperature. Product was purified by HPLC using a 0.1% formic acid in $H_2O$/0.1% formic acid in acetonitrile mobile phase. Product was dried in vacuo. Final yield of Z-Gln-Gly-$NH_2$ was 3.8 mg (23%). ESI-MS (gradient purification) m/z 380.1 ([M+H], 100%). Z-Gln-Gly-$NH_2$ (3.8 mg, $1.01 \times 10^{-5}$ mol) and NHS-PEG$_2$-AuF (10.3 mg, $1.03 \times 10^{-5}$ mol) were dissolved in 0.2 mL DMF. Triethylamine (14 µL, $1 \times 10^{-4}$ mol) was added and reaction was incubated under $N_2$ overnight at room temperature. Half of the reaction was purified by HPLC using a 0.1% formic acid in $H_2O$/0.1% formic acid in acetonitrile mobile phase. Product was dried in vacuo. Final yield of CBZ-Gln-Gly-PEG$_2$-AuF was 3.8 mg (60%). ESI-MS (gradient purification) m/z 634.0 ([M+H]$^{2+}$,100%), 645.1 ([M+Na]$^{2+}$,45%). 1267.0 ([M+H], 16%).

Microbial Transglutaminase Reaction

MAbs ranging in concentrations from 100 µg/mL to 2.5 mg/mL were contacted with 785 µM Z-Gln-Gly-biotin (Zedira, Darmstadt, Germany), Z-Gln-Gly-$N_3$, Z-Gln-Gly-PEG$_2$-BCN, or Z-Gln-Gly-PEG$_2$-AuF with 1 U/mL microbial transglutaminase (Zedira, Darmstadt, Germany) in DPBS for at least 16 h at 37° C.

High-Throughput mTGase Assay

MAbs ranging in concentrations from 500 ng/mL to 10 µg/mL were incubated with 60 µM Z-Gln-Gly-biotin and 0.1 U/mL mTGase (Zedira) in DPBS for at least 16 h at 37° C. A 96-well plate was coated with 1 µg/mL goat-anti-human IgG Fcγ mAb (Jackson ImmunoResesearch) overnight at 4° C. After washing the plate, the overnight mTGase reactions were diluted 1:10 in 50 µL DPBS, added to the plate, and incubated for 1 h at 22° C. The plate was then washed, and 0.1 µg/mL of streptavidin-horseradish peroxidase (HRP) (Jackson ImmunoResesearch) was added to the wells. The plate was washed again, and streptavidin-HRP-bound biotinylated samples were quantitated in relative fluorescent units (RFUs) using QuantaBlue substrate (Thermo) according to the manufacturer's protocol.

Ultra-Performance Liquid Chromatography (UPLC)/ESI-MS Analysis of mAb Conjugation Purified antibodies were diluted to 1 mg/mL in DPBS (if below 1.0 mg/mL samples were left at original concentration). Reactions containing dimethylsulfoxide (DMSO) were desalted using a Zeba spin desalting column. The mAbs were then either deglycosylated using PNGase F (NEB) or digested into Fab'$_2$ and Fc fragments by IdeS (Promega). To deglycosylate the mAbs, G7 buffer (5 or 10 µL) and PNGase F (1 or 2 µL) were added to the mAb (50 or 100 µL). The reaction was incubated in a Discover microwave (CEM) for 2 cycles: 1.) microwave power 10 W, 37° C., 10 min, and then wait for 3-5 min; 2.) microwave power 2 W, 37° C., 10 min. A portion of the deglycosylated sample was reduced by adding dithiothreitol (DTT) to a final concentration of 20 mM, followed by incubation at 60° C. for 3 min. To generate Fab'$_2$ and Fc fragments, 50 U/µL of IdeS was added to 0.5 mg/mL of mAb and incubated at 37° C. for 0.5-1 h. The IdeS samples were or were not reduced.

Samples were then analyzed using a Waters Acquity UPLC and Q-Tof Premier mass spectrometer. Samples (0.5-2 µg each) were injected onto a MassPrep micro desalting column at 65° C., eluted from the column with a 5 min equilibration in 95% of mobile phase A, a 10 min gradient (5-90% B), and a 10 min re-equilibration in 95% of mobile phase A, at 0.05 mL/min Mobile phase A was 0.1% formic acid in water. Mobile phase B was 0.1% formic acid in acetonitrile. The Q-Tof mass spectrometer was run in positive ion, V-mode with detection in the range of 500-4000 m/z. The source parameters were as follows: capillary voltage, 2.25 kV (intact antibody)-2.50 kV (reduced antibody); sampling cone voltage, 65.0 V (intact antibody) or 50.0 V (reduced antibody); source temperature, 100° C.; desolvation temperature, 250° C.; desolvation gas flow, 550 L/hr. The protein peak was deconvoluted using the MassLynx MaxEnt 1 function.

Reverse Phase Liquid Chromatography (LC)-MS

Samples were analyzed using reverse phase liquid chromatography. Samples containing 100 µL of ADC at the concentration of 1-2 mg/mL were reduced with 20 mM DTT at 60° C. for 3 minutes. The samples were analyzed using Waters Alliance HPLC with SQD and PDA detectors. Each sample was injected onto a Proteomix RP-1000 column (5µ, 4.6×150 mm, Sepax) at 65° C. For the LC and HC mutants, separation of the LC and HC occurred with a 3.0 min equilibration in 75% of mobile phase A (0.1% TFA in water) and a 27-minute gradient (25-55% mobile phase B [0.1% TFA in water]) at a flow rate of 1 mL/min The SQD mass spectrometer was run in positive ion, V-mode with detection in the range of 200-2000 m/z. Source parameters were as follows: capillary voltage, 3.20 kV; sampling cone voltage, 40° C.; source temperature, 150° C.; desolvation temperature, 250° C.; desolvation gas flow, 700 L/hr. Scan time, 1 second. The protein peak was deconvoluted by the MassLynx MaxEnt 1 function. The PDA detector was at 280 nm.

The DAR was calculated based on the relative signal intensity of the unconjugated and conjugated LC and unconjugated and conjugated HC. Total DAR was calculated using the following equation: total DAR=(DAR LC+DAR HC)×2.

Example 2: Analysis of Solvent Exposed Lysines on IgG Antibodies

In order to further study the availability of solvent exposed lysines on IgG antibodies, the crystal structures of an IgG1-kappa Fab (4F3F), an IgG1-lambda Fab (4HK0), and IgG1 Fc (1FC1) were examined for potential acyl acceptor sites. As mTGase tends to prefer solvent-exposed substrate glutamines and lysines within loops (Spolaore et al. 2012), solvent exposed lysines were highlighted using Discovery Studio v4.5 with a 1.4 Å probe radius (FIG. 4). There are 7 solvent-exposed lysines in the Antibody 01 VH with 3 in turns or loops. As the number of lysines can vary between mAbs due to utilization of different germline variable region families and somatic hypermutation, the solvent exposure of lysines in the VH region of five other antibodies were also analyzed based on analogous positions of residues in the 4F3F structure. These VH regions potentially contain 1-5 solvent-exposed lysines with 1 or 2 present in a turn or loop. In the Antibody 01 Vκ there are 6 solvent exposed lysines and 4 are in loops or turns. The VK regions from four other antibodies potentially contain 3 to 5 solvent-exposed lysines with 2 in a loop or turn. Antibody 05 utilizes a lambda chain, and the solvent exposure of the lysines was determined using the crystal structure of 4HK0 based on sequence similarity of the light chain. Antibody 05 potentially has 2 solvent-exposed lysines in the Vλ domain with only 1 in a loop. The IgG1 constant domains have 23 solvent-exposed lysines with 13 in loops or turns (FIG. 6). The kappa constant region has 8 lysines with 5 in a turn or loop. The lambda has 6 solvent-exposed lysines with half in loops or turns. In total, the analyzed antibodies range from 42 to 50 solvent-exposed lysines in loops or turns per mAb.

To determine whether microbial transglutaminase can transamidate a native lysine residue on an IgG antibody, antibodies were incubated with Z-Gln-Gly-CAD-biotin and mTGase at 37° C. overnight. The samples were digested with IdeS and reduced with DTT, and the masses of the LC, Fd, and Fc fragments were analyzed by mass spectrometry. Two mass peaks corresponding to the G0F (+1445 Da) and G1F (+1608 Da) glycoforms were observed for each Fc. Antibody 04 also contained an N-linked glycosylation site in VH and two glycan species, and G2FS and G2FS2 glycans were observed. All samples lacked the C-terminal lysine (128 Da), as evidenced by the −130 to −132 Da difference between the observed and theoretical mass for the Fc. Although there are 42-50 potential acyl acceptor lysines in the different antibodies, surprisingly neither the HC nor the LC was modified by the acyl donor substrate (FIG. 7; Table 1).

TABLE 1

ESI-MS analysis of antibodies contacted with an acyl donor and microbial transglutaminase
ZQG-CAD-biotin: +631 Da

| | LC | | | Fd | | | | Fc | | | |
|---|---|---|---|---|---|---|---|---|---|---|---|
| | Calculated | Observed | ΔMass | Calculated | Observed | Glycan | ΔMass | Calculated | Glycan | Observed | ΔMass |
| Antibody 02 | 23751 | 23750 | −1 | 25073 | 25071 | | −2 | 25328 | G0F | 25198 | −130 |
| | | | | | | | | 25491 | G1F | 25360 | −131 |
| Antibody 03 | 23478 | 23478 | 0 | 26097 | 26097 | | 0 | 25388 | G0F | 25258 | −130 |
| | | | | | | | | 25551 | G1F | 25420 | −131 |
| Antibody 01 | 23216 | 23213 | −3 | 25072 | 25069 | | −3 | 25328 | G0F | 25198 | −130 |
| | | | | | | | | 25491 | G1F | 25359 | −132 |
| Antibody 04 | 23532 | 23530 | −2 | 27566 | 27564 | G2FS | −2 | 25296 | G0F | 25166 | −130 |
| | | | | 27857 | 27855 | G2FS2 | −2 | 25459 | G1F | 25327 | −132 |
| Antibody 05 | 22655 | 22653 | −2 | 26340 | 26337 | | −3 | 25328 | G0F | 25198 | −130 |
| | | | | | | | | 25491 | G1F | 25360 | −131 |
| Antibody 06 | 23472 | 23470 | −2 | 25383 | 25381 | | −2 | 25328 | G0F | 25198 | −130 |
| | | | | | | | | 25491 | G1F | 25359 | −132 |

Table 1: The masses of the LC, Fd, and Fc were determined by ESI-MS. The theoretical mass of each fragment was determined by the amino acid sequence subtracted from the observed mass to determine the change in mass (Δmass). A Δmass of −128 Da is due to cleavage of Lys447. The Fc is glycosylated with one or two oligosaccharides, G0F or G1F.

Example 3: Mutation of Natural Amino Acid Residues to Lysine to Create an Acyl Acceptor Site Since there are no acyl acceptor sites in human IgG1 mAbs, lysine scanning mutagenesis was performed on Antibody 01 to identify regions that could be engineered to introduce an acyl acceptor site(s). In order to increase the chances of identifying novel acyl acceptor sites, mutagenesis was limited to solvent-exposed residues within the loops or turns of the constant regions of human IgG1 HC and kappa and lambda LCs (FIG. 6). Mutant mAbs were initially screened for transamidation using an ELISA-based assay by incubating mutants with mTGase and Z-Gln-Gly-CAD-biotin overnight at 37° C. MAbs were captured on an anti-Fcγ coated plate and biotinylated mAbs were detected by HRP-conjugated streptavidin. Wild-type Antibody 01 and Antibody 01-L (which is transamidated at Lys447) were included as negative and positive controls, respectively. The signal for the positive control Antibody 01-L was greater than 12,000 RFU and mutant mAbs ranged from ~1100 RFU to ~11,000 RFU (FIG. 7).

Transamidation of all CH1 and upper hinge mutants to Z-Gln-Gly was analyzed By ESI-MS to determine whether the percentage of conjugation correlates with the RFU signal seen in the ELISA assay. Samples were incubated with mTGase and Z-Gln-Gly overnight at 37° C., and their masses were analyzed by ESI-MS. The RFU signal from the ELISA mostly correlated with the ESI-MS data where RFUs greater than 7000 corresponded to >70% conjugation of mutants S136K, D221K, T223K, and H224K (FIG. 7). The RFU signal for T135K and T225K was below 7000, but those mutants were 80.4% and 100% conjugated, respectively. In contrast, mutant G137K had an RFU of 8616, but only 38.9% was conjugated. Therefore, while a RFU signal >7000 corresponded to a high percentage of transamidation, there were a few false positives and false negatives. Rather than performing a low-throughput ESI-MS screen of the remaining mutants, a cutoff of >4000 RFU was used to pick CH2 and CH3 samples for analysis. Since only two kappa and no lambda samples were greater than 4000 RFU, samples greater than 3000 RFUs were also analyzed.

The transamidation reaction was performed by incubating Z-Gln-Gly-CAD-biotin and mTGase overnight at 37° C. with CH2 mutants M252K, E283K, A287K, and N297K; CH3 mutants P343K, G385K, G420K, H433K, L443K, S444K, and P445K; kappa mutants D151K, L201K, S202K, and E213K; and lambda mutants V147K, Q187K, and E213K; and subsequent analysis was performed by ESI-MS (FIG. 7). Three additional CH1 mutants, S191K, S192K, and L193K, were analyzed by ESI-MS, but were not including in the initial ELISA screen. Of these mutants, the CH1 mutant L193K, CH2 mutant M252K, the CH3 mutant P445K, the kappa mutants L201K and S202K, and the lambda mutant E213K were greater than 70% conjugated (FIG. 7). The results for the CH2 mutant N297K were inconclusive due to very low signal.

The mutants identified as having the highest conjugation efficiency were re-analyzed in a single experiment using the Z-Gln-Gly-CAD-biotin substrate. The region of conjugation was confirmed by digesting the samples with IdeS and reduction prior to ESI-MS analysis to generate Fd (CH1 and hinge), Fc (CH2 and CH3), and LC fragments. Conjugation to N297K was again inconclusive due to low Fc signal despite high Fd and LC signals. Transamidation of samples all correlated to the domain containing the lysine mutation. T135K and P445K mutants were conjugated at 100%, and conjugation to M252K was nearly 100% (FIG. 8). The S136K and S221K mutations were greater than 80% conjugated. The other three hinge mutants had conjugation efficiencies of less than 50%. Both LC mutants were greater than 80% conjugated.

Example 4: Inserting a Lysine Residue to Create an Acyl Acceptor Site

Residues Ser190 through Thr195 form a beta turn that connects beta strands E and F. Lysine scanning through this exposed area showed only one site—position 193—is an acceptable acyl donor site. This region forms an alpha helix, and it was possible that this secondary structure prevents transamidation in this region. To potentially disrupt the structure in this region, a lysine was inserted between Ser191 and Ser192, Ser192 and Leu193, or Leu193 and Gly194. Samples were incubated with mTGase and Z-Gln-Gly-CAD-biotin overnight at 37° C., and their masses were analyzed by ESI-MS. Insertion of a lysine between Ser191 and Ser192 or Ser192 and Leu193 was 100% transamidated, but not when inserted between Leu193 and Gly194 (Table 2).

TABLE 2

(SEQ ID NOS: 295-297) Transamidation of a lysine insertion Z-Gln-Gly-CAD -biotin: +631 Da

| | sequence | Calculated | Observed | ΔMass | % conjugated |
|---|---|---|---|---|---|
| S191.K.S192 | SSKSLGT | 48937 | 49565 | 628 | 100.0% |
| S192.K.L193 | SSSKLGT | 48937 | 49565 | 628 | 100.0% |
| L193.K.G194 | SSSLKGT | 48937 | 48934 | -3 | 0.0% |

MAbs were incubated with Z-Gln-Gly-CAD-biotin and mTGase at 37° C. overnight. The masses of the non-reduced mAbs were analyzed by ESI-MS (data not shown), and the percent conjugation to Z-Gln-Gly-CAD-biotin (Δmass = 631 Da) was determined as above. The DAR was determined by dividing the Δmass by the mass of Z-Gln-Gly-CAD-biotin.

Example 5: Transamidation Resulting From Addition of a Lysine to the LC C Terminus It was previously demonstrated that the HC C-terminal Lys447 residue is a site of transamidation when cleavage of Lys447 is blocked by an additional C-terminal residue at position 448, see U.S. Provisional Application No. 62/269,138, filed on Dec. 18, 2015, and PCT/US2016/067165 filed on Dec. 16, 2016, the entire contents of each of which are expressly incorporated herein by reference. A lysine was engineered to the C terminus of the LC to determine whether a single C-terminal lysine extension is sufficient to act as an acyl acceptor site. In contrast to the native C-terminal lysine in the HC, a C-terminal lysine on the LC was not cleaved by a carboxypeptidase (Table 3). However, this engineered lysine was not an acyl acceptor site. An additional leucine was engineered to the C terminus of the engineered lysine (LC-KL), as a Lys-Leu motif at the C terminus of the HC is efficiently transamidated. However, LC-KL was not transamidated. The native C-terminal cysteine (Cys214) in the LC forms an interchain disulfide bond with the HC, and this region is buried in crystal structures of this region (data not shown). It could be that steric hindrance or lack of solvent exposure prevents transamidation. A single leucine was added between Cys214 and the lysine in an attempt to make the lysine more accessible to MTGase. Again, no cleavage was seen to the C-terminal lysine, and no transamidation was observed to the LK motif. However 9.1% of the LCs with the LKL motif were transamidated. To extend the lysine further away from the LC-HC interface, a Gly-Ser linker was inserted between Cys214 and the lysine. This extension resulted in cleavage of a C-terminal lysine (GGSGK) (SEQ ID NO: 298). Protecting cleavage of the lysine by addition of a C-terminal leucine (GGSGKL) (SEQ ID NO: 287) resulted in the LCs being 77.8% transamidated.

TABLE 3

Transamindation of a C-terminal lysine addition to the LC
Z-Gln-Gly-CAD-biotin: +631 Da

|  | Calculated | Observed | ΔMass | % conjugated |
|---|---|---|---|---|
| Antibody 01-LC-K | 23340 | 23343 | 3 | 0.0% |
|  | 23340 | 23344 | 4 |  |
| Antibody 01-LC-KL | 23453 | 23457 | 4 | 0.0% |
| Antibody 01-LC-LK | 23453 | 23457 | 4 | 0.0% |
| Antibody 01-LC-LKL | 23566 | 23569 | 3 | 9.1% |
|  | 23566 | 23570 | 4 |  |
|  | 23566 | 24201 | 635 |  |
| Antibody 01-LC-GGSGK | 23598 | 23473 | −125 | 0.0% |
|  | 23598 | 23474 | −124 |  |
| Antibody 01-LC-GGSGKL | 23711 | 23714 | 3 | 77.8% |
|  | 23711 | 24345 | 634 |  |

MAbs were incubated with Z-Gln-Gly-CAD-biotin and mTGase at 37° C. overnight. The masses of the reduced LCs were analyzed by ESI-MS, and the percent conjugation to Z-Gln-Gly-CAD-biotin (Δmass = 631 Da) was determined as in (Table 1).

Example 6: Analysis of Additional Acyl Donors

One utility of conjugations to an acyl acceptor on a mAb is for the manufacturing of site-specific ADCs. Conjugation of functional agents to a mAb could be achieved by one of two methods. First, a 2-step method would require mTGase conjugation of a lysine to an acyl donor synthesized with a reactive group such as BCN, DBCO, TCO, azido ($N_3$), alkyne, tetrazine, or maleimide. The second step involves conjugation of a functional agent to the reactive group using, for example, copper-free click chemistry or thiol-reactive chemistry. Z-Gln-Gly-$N_3$ is not available commercially; therefore aminopropyl-$N_3$ was added to the hydroxyl group of Z-Gln-Gly as detailed in the Methods section. Antibody 01 with lysine mutations in the HC or LC were incubated with Z-Gln-Gly-N3 or Z-Gln-Gly-$PEG_2$-BCN and mTGase as above. The samples were desalted and analyzed by LC-MS to determine addition of the substrate to the mAb. Z-Gln-Gly-$N_3$ was added efficiently (>75% conjugation or DAR 1.5) for most lysine substitutions (Table 4). The most permissible sites of transamidation were HC-S135K, HC-L193K, HC-D221K, HC-M252K, HC-N297K, HC-P445K, and LC-L201K. Mutants HC-T136K, HC-T223K, HC-T225K, LC-S202K, and LC-GGSGKL (SEQ ID NO: 287) were all transamidated >75% with Z-Gln-Gly-CAD-biotin (FIG. 7), but not with Z-Gln-Gly-$N_3$. Therefore, not all acyl donors equally transamidate the same acyl acceptor site. This was also demonstrated by Z-Gln-Gly-$PEG_2$-BCN where no acyl acceptor site was efficiently transamidated (Table 4). Contrary to Z-Gln-Gly-$N_3$, the percentage of transamidation by Z-Gln-Gly-$PEG_2$-BCN did not vary widely among the acyl acceptor sites. For example, there was a 32% difference in transamidation of T135K and S136K by Z-Gln-Gly-$N_3$, but only a 4% difference with Z-Gln-Gly-$PEG_2$-BCN.

TABLE 4

Transamidation with various acyl donors

| HC Mutation | Z-Gln-Gly-$N_3$ | Z-Gln-Gly-$PEG_2$-BCN | Z-Gln-Gly-$PEG_2$-AuF | DAR Species |
|---|---|---|---|---|
| T135K | 89.1% | 27.1% | 51.4% | 1 |
| S136K | 59.6% | 23.1% | 16.1% | 1 |
| L193K | 81.5% | 63.7% | 23.3% | 1 |
| D221K | 55.1% | 31.5% | 39.7% | 1 |
|  | 8.5% |  |  | 2 |
| T223K | 48.7% | 0.0% | ND | 1 |
| H224K | 55.7% | 17.3% | ND | 1 |
| T225K | 34.1% | 0.0% | ND | 1 |
| M252K | 89.0% | 15.6% | 82.8% | 1 |
| N297K | 27.6% | 6.0% | 46.5% | 1 |
|  | 41.3% | 0.0% | 30.4% | 2 |
|  | 23.7% | 0.0% | 4.5% | 3 |
| P445K | 73.0% | 49.6% | 48.7% | 1 |

MAbs were incubated with Z-Gln-Gly-$N_3$, Z-Gln-Gly-$PEG_2$-BCN, or Z-Gln-Gly-$PEG_2$-AuF and mTGase at 37° C. overnight. The masses of the reduced mAbs were analyzed by LC-MS (data not shown), and the percent conjugation to Z-Gln-Gly-CAD-biotin (Δmass = 631 Da) was determined as in (Table 1).

Interestingly, conjugation to D221K and N297K resulted in multiple conjugation sites in the HC. The D221K mutation is adjacent to Lys222, which is not typically an acyl acceptor site. Perhaps the presence of an adjacent lysine facilitates a low level of transamidation of Lys222. Of note, only the Z-Gln-Gly-$N_3$ substrate is conjugated at more than one site in the D221K mutant. The structure of Z-Gln-Gly-$N_3$ is smaller than the other substrates tested (FIG. 2), and it is likely that steric hindrance of the second conjugation site blocks its transamidation by the other substrates.

The N297K mutation removes the glycosylation site at Asn297. Aglycosylated mAbs adopt a different structure than the glycosylated forms. The N297Q mutation also results in an aglycosylated mAb and perturbs the structure in such a way that Gln295 is then transamidated by a variety of acyl acceptor substrates (Mindt, T. L. et al., 2008, Modification of different IgG1 antibodies via glutamine and lysine using bacterial and human tissue transglutaminase, *Bioconjug. Chem* 19:271-278; Jeger,S. et al., 2010, Site-specific and stoichiometric modification of antibodies by bacterial transglutaminase, *Angew. Chem Int Ed Engl* 49:9995-9997; Dennler, P.et al., 2014, Transglutaminase-based chemo-enzymatic conjugation approach yields homogeneous antibody-drug conjugates, *Bioconjug. Chem* 25:569-578). N297K likely changes the confirmation of the CH2 region resulting in native lysines now becoming acyl acceptors sites for Z-Gln-Gly-$N_3$.

A second conjugation method involves a single conjugation step whereby a functional agent is synthesized with an acyl donor group. This method was tested by synthesizing a Z-Gln-Gly group onto $PEG_2$-Auristatin F (Z-Gln-Gly- PEG$_2$-AuF). The Z-Gln-Gly-PEG$_2$-AuF was incubated with Antibody 01 HC and LC lysine mutants and mTGase overnight at 37° C. The samples were desalted and analyzed by LC-MS to determine addition of the substrate to the mAb. All HC mutants tested demonstrated various amounts of conjugation (Table 4). The efficiency of conjugation at certain sites did not correspond with the efficiency of conjugation seen with Z-Gln-Gly-N$_3$. Conjugation to Z-Gln-Gly-PEG$_2$-AuF was low for T135K, L193K, and D221K but high for Z-Gln-Gly-N$_3$. L201K was the most efficient with 92% of the LCs conjugated to Z-Gln-Gly-PEG$_2$-AuF. N297K again demonstrated multiple conjugation sites, but the efficiency was not as high as with Z-Gln-Gly-N$_3$.

Example 7: Generating Multiple Acyl Acceptor Sites on a Single Antibody

A mutant mAb with one engineered acyl acceptor site yields a theoretical DAR of 2. By combining multiple engineered acyl acceptor sites, the theoretical DAR increases by 2 for each site. Increasing the drug load of an ADC results in delivery of more cytotoxic drugs into a target cell per mAb, which may allow for lower patient dosing. To determine whether multiple acyl acceptor sites could yield a mAb with a ratio of functional agent to immunoglobulin of greater than 2, mAbs were engineered to include the LC mutant L201K or S202K in combination with the CH1 mutations T135K or S136K, the CH1-CH2 mutations S136K-N297K, the CH1-CH2-CH3 mutations S136K-N297K-P445K, or the CH1-CH3 mutations T135K-L448 to yield mAbs with 4, 6, 8 or 6 acyl acceptor sites, respectively.

T135K-based samples were incubated with mTGase and Z-Gln-Gly-CAD-biotin overnight at 37° C., and their masses were analyzed by LC-MS following reduction. The L201K LCs were 100% conjugated in all samples (Table 5). The S202K LC in the single T135KHC mutant had more than double the efficiency of the double T135K-L448HC mutant (69.8% versus 31.8%). T135K was 100% conjugated when combined with just the L201KLC mutation, resulting in a DAR of 4.0. In combination with the S202KLC mutation, conjugation was reduced to 88.7% with an average DAR of 3.17. Combining T135K with the L448HC mutation resulted in 100% conjugation to the mAbs. However, the DAR was heterogeneous with 77.1% containing 2 biotins per HC and 22.9% containing only 1 biotin yielding an average DAR of 3.54. When the double-HC mutations were combined with a LC mutation, conjugation efficiency to the HC dropped. The amount of DAR 1 species more than doubled and the DAR 2 species dropped 2.3- to 6.5-fold. Despite these two mAb having a potential DAR of 6, the average DAR was less than 4.

TABLE 5

Combining lysine mutations resulted in multiple acyl acceptor sites on a single mAb

| Z-Gln-Gly-CAD-biotin | % HC conjugation DAR 1 | | % LC conjugation DAR 2 | Ave DAR DAR 1 |
|---|---|---|---|---|
| T135KHC/L201KLC | 100.0% | 0.0% | 100.0% | 4.00 |
| T135KHC/S202KLC | 88.7% | 0.0% | 69.8% | 3.17 |
| T135K-L448HC | 22.9% | 77.1% | 0.0% | 3.54 |
| T135K-L448HC/L201KLC | 56.0% | 11.9% | 100.0% | 3.59 |
| T135K-L448HC/S202KLC | 52.8% | 33.2% | 31.8% | 3.02 |

| | % CH1 conjugation DAR 1 | % LC conjugation DAR 1 | Ave DAR |
|---|---|---|---|
| S136KHC/S202KLC | 85.5% | 72.5% | 3.16 |
| S136K-N297KHC/S202KLC | 88.1% | 59.7% | 2.95 |
| S136K-N297K-P445KHC/S202KLC | 84.5% | 56.0% | 2.80 |

MAbs were incubated with Z-Gln-Gly-CAD-biotin and mTGase at 37° C. overnight. The masses of the reduced T135K mutants were analyzed by LC-MS, and the percent conjugation to Z-Gln-Gly-CAD-biotin (Δmass = 631 Da) was determined as above. The S136K mutant mAbs were digested with IdeS, reduced, and analyzed by ESI-MS. The signal from the Fc fragments was too low to analyze.

Samples containing the S136KHC mutation were incubated with mTGase and Z-Gln-Gly-CAD-biotin overnight at 37° C., and their masses were analyzed by ESI-MS following IdeS digestion and reduction. The CH1 and light chain of all samples were transamidated (Table 5). S136K was 84.5% to 88.1% conjugated for all samples. S202K transamidation was higher in the single S136K mutant versus the double and triple HC mutants (72.5% versus 56% or 59.7%). The DAR for S136KHC/S202KLC was 3.16 out of 4 potential sites. The ESI-MS signal for the Fc fragments containing the N297K mutation was very low, and the conjugation efficiency could not be determined. Therefore the DARs for the double- and triple-HC mutants were at least 2.95 and 2.8.

Figure 11:
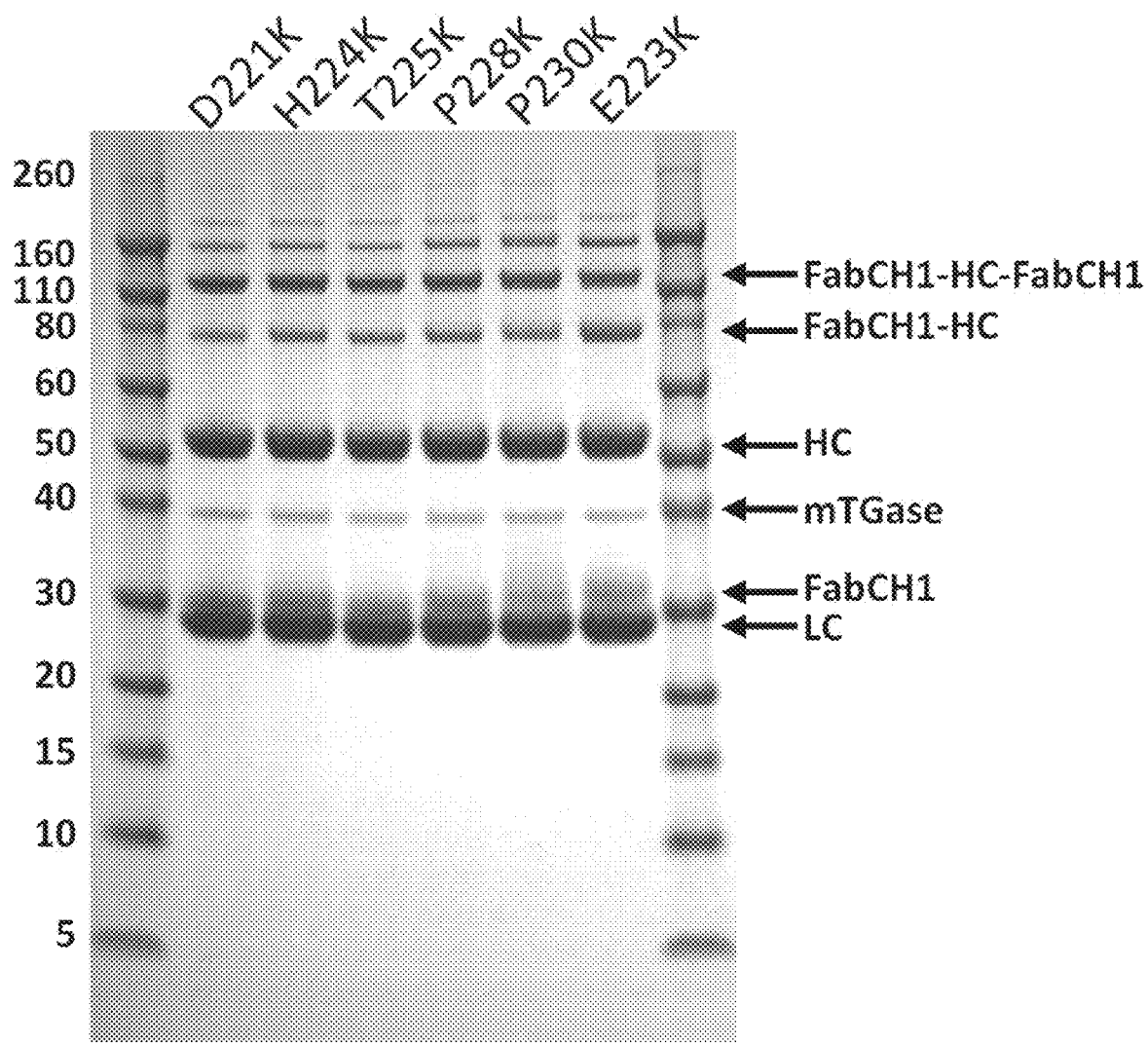
FIG. 11 shows Fab's with an acyl acceptor were conjugated to the Q295 and/or Q297 acyl donor site in the mAb mutant. Antibody 01-N297Q was incubated with Fab' lysine mutants and mTGase overnight at 37° C. The samples were reduced and analyzed by SDS-PAGE using a 4-12% Bis-Tris polyacrylamide gel. The mass of the FabCH1-HC dimer is approximately 75 kDa and the FabCH1-HC-FabCH1 trimer is approximately 100 kDa.

Transamidation of multiple sites by other acyl donor substrates was also examined. The T135K-based mutants were incubated with Z-Gln-Gly-N$_3$, Z-Gln-Gly-PEG$_2$-BCN, or Z-Gln-Gly-PEG$_2$-AuF and mTGase overnight at 37° C. Conjugation to the LC L201K and S202K sites by each of the substrates was similar between these multiple-mutation mAbs and the single L201K and S202K mutations shown in Table 4, except no conjugation of Z-Gln-Gly-PEG$_2$-BCN to the LC mutations was observed (FIG. 11). The two mutants containing a single T135K mutation plus a single LC mutation demonstrated conjugation efficiency to T135K similar to the single T135K in Table 4 for all acyl donor substrates. Adding the second mutation L448 mutation resulted in mixtures of samples with DAR 1 and DAR 2 on the HC. The samples transamidated most efficiently were T135KHC/L201KLC+Z-Gln-Gly-N$_3$ (DAR 3.57 out of 4), T135K-L448HC+Z-Gln-Gly-N$_3$ (DAR 3.1 out of 4), and T135K-L448HC/L201KLC+Z-Gln-Gly-N$_3$ (DAR 5.04 out of 6).

Example 8: Analysis of the Lysine Substitutions in Other IgG Isotypes

The Fc of IgG1, IgG2, IgG3, and IgG4 are 89.2% identical (FIG. 10, alignment sequence), therefore it was possible that lysine insertions or substitutions at positions in IgG2, IgG3, and IgG4 analogous to IgG1 could be engineered acyl acceptor sites for mTGase. First, wild-type IgG2, IgG3, and IgG4 were analyzed to determine whether there are any native acyl acceptor sites specific to these isotypes. MAbs were incubated with mTGase and Z-Gln-Gly-CAD-biotin overnight at 37° C. The samples were digested with IdeS and the masses of the Fcs were analyzed by ESI-MS. As with IgG1, there was no transamidation of wild-type IgG2, IgG3, or IgG4 (Table 6).

Lysine substitutions were made at positions analogous to IgG1 (M252, N297, and P445). Except for IgG4 that encodes for a leucine at position 445, there are no differences at these residues between the isotypes (FIG. 10). Mutant mAbs were incubated with mTGase and Z-Gln-Gly-CAD-biotin overnight at 37° C. The samples were digested with IdeS and the masses of the Fcs were analyzed by ESI-MS. The mutants N297K and M252K were efficiently transamidated with the N297K mutants yielding more than one conjugation site per HC as with IgG1 (Table 7). IgG2-N297K and IgG4-N297K contained 2 acyl acceptor sites while IgG3 contained 3. The mutant P445K was only efficiently transamidated for the IgG2 isotype. P445K transamidation was only 62.6% and 50.6 for IgG3 and IgG4, respectively.

TABLE 7

Engineered acyl acceptor sites in IgG1 Fc were also acceptor sites in IgG2, IgG3, and IgG4.
ZQG-CAD-biotin = 631 Da

|  | Calculated | Glycan | Observed | ΔMass | % of total | % conjugation |
|---|---|---|---|---|---|---|
| IgG2 N297K | 23803 | — | 24434 | 631 | 78.6% | 100.0% |
|  |  |  | 25059 | 1256 | 21.4% |  |
| IgG3 N297K | 23837 | — | 24468 | 631 | 28.2% | 100.0% |
|  |  |  | 25099 | 1262 | 40.8% |  |
|  |  |  | 25730 | 1893 | 31.0% |  |
| IgG4 N297K | 23785 | — | 24416 | 631 | 81.6% | 100.0% |
|  |  |  | 25047 | 1262 | 18.4% |  |
| IgG2 M252K | 25231 | G0F | 25231 | 0 | 14.2% | 85.8% |
|  | 25231 | G0F | 25862 | 631 | 69.5% |  |
|  | 25394 | G1F | 26024 | 630 | 16.3% |  |
| IgG3 M252K | 25265 | G0F | 25265 | 0 | 7.4% | 92.6% |
|  | 25265 | G0F | 25896 | 631 | 50.7% |  |
|  | 25428 | G1F | 26058 | 630 | 41.9% |  |
| IgG4 M252K | 25213 | G0F | 25844 | 631 | 57.4% | 100.0% |
|  | 25376 | G1F | 26006 | 630 | 42.6% |  |
| IgG2 P445K | 25265 | G0F | 25895 | 630 | 64.7% | 100.0% |
|  | 25428 | G1F | 26058 | 630 | 35.3% |  |
| IgG3 P445K | 25299 | G0F | 25299 | 0 | 21.1% | 61.6% |
|  | 25462 | G1F | 25461 | −1 | 17.3% |  |
|  | 25299 | G0F | 25930 | 631 | 34.3% |  |
|  | 25462 | G1F | 26092 | 630 | 27.4% |  |
| IgG4 L445K | 25231 | G0F | 25231 | 0 | 25.7% | 50.6% |
|  | 25394 | G1F | 25393 | −1 | 23.7% |  |
|  | 25231 | G0F | 25862 | 631 | 27.6% |  |
|  | 25394 | G1F | 26024 | 630 | 23.0% |  |

MAbs were incubated with Z-Gln-Gly-CAD-biotin and mTGase at 37° C. overnight, followed by digestion with IdeS to generate F(ab')₂ and Fc fragments. The masses of the IdeS-generated Fc fragments were analyzed by ESI-MS as above, and the percent conjugation to Z-Gln-Gly-CAD-biotin (Δmass = 631 Da) was determined as disclosed herein.

TABLE 6

IgG2, IgG3, and IgG4 have no acyl acceptor sites.
Z-Gln-Gly-CAD-biotin: +631 Da

|  | Glycan | Calculated | Observed | ΔMass | % conjugated |
|---|---|---|---|---|---|
| IgG2 | G0F | 25362 | 25232 | −130 | 0.0% |
|  | G1F | 25525 | 25394 | −131 |  |
| IgG3 | G0F | 25396 | 25266 | −130 | 0.0% |
|  | G1F | 25559 | 25428 | −131 |  |
| IgG4 | G0F | 25344 | 25214 | −130 | 0.0% |
|  | G1F | 25507 | 25376 | −131 |  |

MAbs were incubated with Z-Gln-Gly-CAD-biotin and mTGase at 37° C. overnight, followed by digestion with IdeS to generate F(ab')₂ and Fc fragments. The masses of the IdeS-generated Fc fragments were analyzed by ESI-MS as above, and the percent conjugation to Z-Gln-Gly-CAD-biotin (Δmass = 631 Da) was determined as disclosed herein.

Example 9: Transamidation Sites in the Fab' Region

The hinge of IgG is a flexible linker between CH1 and CH2, and it is therefore possible that this flexibility would allow transamidation of acyl acceptors in this region. Zhang, et al., 3D Structural Fluctuation of IgG1 Antibody Revealed by Individual Particle Electron Tomography, Sci Rep, (2015) 5:9803. Indeed, upper hinge mutants D221K, T223K, H224K, and T225K are efficiently transamidated; however, there was no transamidation of middle or lower hinge mutants. This lack of transamidation may be due to structural constraints of the interchain disulfide bonds and proximity to CH2, respectively. To determine whether these residues can be transamidated when relieved of any structural constraints, lysine mutations were made in the context of a Fab' containing the entire hinge region with Cys226 and Cys229 mutated to alanine (DTHTAPPAPAPELL) (SEQ ID NO: 299).

The transamination of mutant Fab's was determined by ESI-MS as above using Z-Gln-Gly-CAD-biotin as the acyl donor. The masses of the HC portion of the Fab's were as expected except for the mutant L235K. This mutation results in a C-terminal lysine residue that was cleaved, likely due to carboxypeptidase B as with full length IgG. Harris et al., Structural characterization of a recombinant CD4-IgG hybrid molecule, *Eur J Biochem,* (1990) 194:611-620; Harris, Processing of C-terminal lysine and arginine residues of proteins isolated from mammalian cell culture, *J Chromatogr.A,* (1995) 705:129-134; Dick, Jr. et al., C-terminal lysine variants in fully human monoclonal antibodies: investigation of test methods and possible causes, *Biotechnol. Bioeng.,* (2008) 100:1132-1143. While no transamidation of full-length IgG was seen, a minor amount of transamidation (4.7%) was seen in the wild-type Fab', possibly at Lys222 (FIG. 9). Scanning lysine mutagenesis of the Fab' revealed several acyl acceptor sites at positions D221, T223, H224, T225, P230, and E233. These Fab's were transamidated with 1 or 2 biotins, with one on the engineered lysine and the second on a native lysine.

As secondary structure plays a large part in determining whether a lysine is transamidated, and the secondary structure of the hinge between the Fab' mutants is unlikely to change significantly, it was unexpected that the native Lys222 and mutants C226K, P227K, C229K, A231K, P232K, L234K, and L235K were not transamidated. The primary sequences surrounding the lysine mutations were analyzed. It was previously demonstrated that a residue C-terminal (+1) to an acyl acceptor affect transamidation; specifically a +1 acidic or proline residue results in little to no transamidation see, e.g., U.S. Provisional No. 62/269,138 filed on Dec. 18, 2015, and PCT/US2016/067165 filed on Dec. 16, 2016, the entire contents of each of which are expressly incorporated herein by reference. The mutants C226K, P227K, C229K, and A231K all have a +1 proline and P232K has a +1 glutamate. In addition, Lys222 and L234K have a −1 acidic residue. It is possible that any acidic residue flanking an acyl acceptor inhibits transamidation. Therefore, alanine mutations were made to mutate either the −1 or +1 acidic residue or +1 proline. Indeed, mutating the acidic and proline residues resulted in efficient transamidation of the lysine substitutions (Table 8). The D221A mutation increased transamidation from 5% to 66%. Similarly, mutating the −1 or +1 acid residues in the P232K, E233A and E233A, L234K Fab's resulted in increased transamidation from 46% to 93% and 62% to 86%, respectively. Mutation of a +1 proline had similar results for lysine mutants C226K (52% to 71%), P227K (57% to 81%), C229K (33% to 91%), and A231K (22% to 93%).

The effect of the hinge length on transamidation of mutants T223K, H224K, T225K, P228K, P230K, and E233K was analyzed by deleting all but the adjacent +1 residue. Removing the C-terminal hinge residues had no negative effect on transamidation of the engineered acyl acceptor site for mutants T223K, H224K, and T225K, and increased transamidation of mutants P228K, P230K, and E233K (Table 8).

TABLE 8

(SEQ ID NOS: 300-326) Hinge lysine mutations in a Fab', but not a mAb, were acyl acceptors.

| | | % conjugation | | |
|---|---|---|---|---|
| | | +1 biotin | +2 biotins | Total |
| M9-Fab | DKTHTAPPAPAPELL | 4.7% | | 4.7% |
| D221A | AKTHTAPPAPAPELL | 65.9% | | 65.9% |
| D221K | KKTHTAPPAPAPELL | 89.6% | | 89.6% |
| T223K | DKKHTAPPAPAPELL | 51.1% | 34.2% | 85.3% |
| T223K-H | DKKH | 56.6% | 25.9% | 82.5% |
| H224K | DKTKTAPPAPAPELL | 87.7% | 2.6% | 90.2% |
| H224K-T | DKTKT | 83.6% | 5.4% | 89.0% |
| T225K | DKTHKAPPAPAPELL | 69.6% | 12.2% | 81.8% |
| T225K-A | DKTHKA | 62.6% | 14.2% | 76.8% |
| C226K | DKTHTKPPAPAPELL | 52.2% | | 52.2% |
| C226K, P228A | DKTHTKAPAPAPELL | 60.1% | 11.2% | 71.3% |
| P227K | DKTHTAKPAPAPELL | 56.8% | | 56.8% |
| P227K, P228A | DKTHTAKAPAPELL | 62.6% | 17.9% | 80.5% |
| P228K | DKTHTAPKAPAPELL | 16.5% | | 16.5% |
| P228K-A | DKTHTAPKA | 65.8% | 28.7% | 94.4% |
| C229K | DKTHTAPPKPAPELL | 32.5% | | 32.5% |
| C229K, P230A | DKTHTAPPKAAPELL | 77.3% | 13.3% | 90.6% |

TABLE 8-continued (SEQ ID NOS: 300-326) Hinge lysine mutations in a Fab', but not a mAb, were acyl acceptors.

| | | % conjugation | | |
|---|---|---|---|---|
| | | +1 biotin | +2 biotins | Total |
| P230K | DKTHTAPPAKAPELL | 63.9% | 14.8% | 78.7% |
| P230K-A | DKTHTAPPAKA | 75.7% | 17.1% | 92.8% |
| A231K | DKTHTAPPAPKPELL | 22.0% | | 22.0% |
| A231K, P232A | DKTHTAPPAPKAELL | 79.3% | 13.6% | 92.9% |
| P232K | DKTHTAPPAPAKELL | 40.6% | 5.5% | 46.2% |
| P232K, E233A | DKTHTAPPAPAKALL | 85.0% | 7.7% | 92.6% |
| E233K | DKTHTAPPAPAPKLL | 51.5% | | 51.5% |
| E233K-L | DKTHTAPPAPAPKL | 82.4% | 9.0% | 91.4% |
| L234K | DKTHTAPPAPAPEKL | 53.2% | 8.5% | 61.7% |
| E233A, L234K | DKTHTAPPAPAPAKL | 75.4% | 10.9% | 86.3% |
| L235K | DKTHTAPPAPAPELK | 7.8% | | 7.8% |

Purified mutant hinge mutant Fab's were screened for transamidation by incubating mTGase with Z-Gln-Gly-CAD-biotin overnight at 37° C. The masses of the HC were analyzed by ESI-MS and the percentage of conjugation was determined.

Example 10: Generation of Dimeric Antibody Molecules

In addition to mTGase mediating transamidation between a small molecule acyl donor and a large molecule acyl acceptor, the transamidation of mutant Fabs with a mAb containing an acyl donor was analyzed. The mAb mutant N297Q contains two acyl donor sites at positions 295 and 297. Jeger et al., Site-specific and stoichiometric modification of antibodies by bacterial transglutaminase, *Angew. Chem Int Ed Engl*, (2010) 49:9995-9997. Fab' mutants D221K, H224K, T225K, P228K, P230K, and E233K were incubated with N297Q and mTGase overnight at 37° C. The samples were reduced and analyzed on by SDS-PAGE. Unconjugated mAb and Fab' will yield bands at 23 kDa (LC), 25 kDa (Fab-Vh-CH1), 38 kDa (mTGase), and 49 kDa (HC). A single mAb-Fab' conjugation will result in a band at 73 kDa and conjugation of two Fab's to a mAb will result in a band at 98 kDa. Indeed, all samples contain bands at both ~75 and ~100 kDa (FIG. 11).

Conclusion to Examples

Given the number of native lysines in exposed loops and turns within an antibody, it was unexpected to find no suitable acyl acceptors on any antibody tested. These results are in direct contrast to the prior thinking in the field, including those reported by Mindt et al., 2008), who allegedly demonstrated conjugation of an average of 0.3 molecules of a fluorescent dye to a natural lysine residue on the antibody chCE7. Mindt also allegedly reported a low level (0.1 molecules/antibody) of transamidation of an acyl acceptor substrate to the same antibody, chCE7. However, numerous later publications could not replicate the findings of Mindt (see Strop et al., 2013; Jeger et al., 2010; and Siegmund et al., 2015). Specifically, Jeger noted that "no modification of native chCE7 or RTX was observed with any of the substrates" (see Jeger et al., 2010). Therefore, the findings disclosed in Mindt were likely either due to background fluorescence of the assay or specific to the acyl acceptor or donor being located in the variable regions of chCE7.

While no acyl acceptors were found on wild-type monoclonal antibodies, single amino acid lysine substitutions surprisingly revealed several positions throughout an antibody that can be engineered to be acyl acceptors. At least one site was identified in each of the constant region domains of the HC and LCs (FIG. 12). Beyond their position in solvent-exposed loops or turns, there was no clear consensus sequence surrounding the acyl acceptor sites. Examples of sequences of the sites that were transamidated greater than 70% were KSK$_{135}$SG (SEQ ID NO: 327), STK$_{136}$GG (SEQ ID NO: 328), SSK$_{193}$GT (SEQ ID NO: 329), TLK$_{252}$IS (SEQ ID NO: 330), QYK$_{297}$ST (SEQ ID NO: 331), LSK$_{445}$G* (SEQ ID NO: 332), QGK$_{201}$SS (SEQ ID NO: 333), GLK$_{202}$SP (SEQ ID NO: 334), PTK$_{213}$CS (SEQ ID NO: 335). Similar sequences are found surrounding lysines that were not transamidated, such as in CH1 (SSK$_{133}$ST) (SEQ ID NO: 336), CH3 (LTK$_{360}$NQ) (SEQ ID NO: 337), and kappa (QLK$_{126}$SG (SEQ ID NO: 338), LSK$_{183}$AD (SEQ ID NO: 339)).

An acidic or proline residue flanking a lysine did hinder the efficiency of transamidation, as demonstrated by mutations in the hinge of Fabs. In addition to mutating a residue to a lysine, acyl acceptor site can be engineered by mutating residues flanking an existing lysine. Based on the transamidation of Lys222 in the Fab mutant D221A, mutation of other proline or acidic residues flanking native lysine throughout the mAb is possible. For instance, IgG1 lysines PK$_{246}$P, PK$_{248}$D, TK$_{290}$P, GK$_{317}$E, and DK$_{414}$S, kappa lysines SK$_{169}$D and EK$_{188}$H, and lambda lysine EK$_{207}$T are flanked by acidic and proline residues, and mutation to something other than an acidic or proline residue may create an acyl acceptor site at that particular lysine. Further, it may be possible that some sites were missed in the lysine scanning mutagenesis due to the mutant lysine being adjacent to an acidic or proline residue, as was the case for several Fab hinge mutants.

The structure surrounding the residue was also shown to influence transamidation. By relieving the core and lower hinge region of any structure contributed by CH2 and/or the interchain disulfide bonds through the generation of Fab fragments lysines that were not transamidated in the context of a mAb were transamidated in a Fab. In the context of a full-length mAb with interchain disulfide bonds at cysteines 226 and 229, P230K and E233K were not transamidated. However, in the context of a Fab fragment and no interchain disulfide bonds these residues were transamidated. A disulfide bond flanking an acyl acceptor site in amongst itself does not hinder transamidation, as the +1 position in the lambda mutant E213K is an interchain disulfide bond, and the mutant was transamidated. Therefore, either changing the three-dimensional structure of the hinge region by removing the interchain disulfide bonds and/or removing possible steric constraints of the nearby CH2 domain allowed transamidation of lysines at these sites.

MTGase has previously been investigated as a means to transamidate glutamines by engineering mAbs by one of two methods. Josten, et al., Use of microbial transglutaminase for the enzymatic biotinylation of antibodies, J Immunol.Methods, (2000) 240:47-54; Mindt, et al., Modification of different IgG1 antibodies via glutamine and lysine using bacterial and human tissue transglutaminase, Bioconjug.Chem, (2008) 19:271-278; Jeger, et al., Site-specific and stoichiometric modification of antibodies by bacterial transglutaminase, Angew.Chem Int Ed Engl, (2010) 49:9995-9997; Strop, et al., Location matters: site of conjugation modulates stability and pharmacokinetics of antibody drug conjugates, Chem Biol, (2013) 20:161-167. While effective in conjugating amine-based substrates on mAbs, both methods have disadvantages. The first approach requires deglycosylation of the mAb either enzymatically or by mutagenesis. Mindt, et al., Modification of different IgG1 antibodies via glutamine and lysine using bacterial and human tissue transglutaminase, Bioconjug.Chem, (2008) 19:271-278; Jeger, et al., Site-specific and stoichiometric modification of antibodies by bacterial transglutaminase, Angew.Chem Int Ed Engl, (2010) 49:9995-9997. Aglycosylated mAbs undergo a conformational change that decreases the thermal stability, increases protease susceptibility, and increases aggregation rates. Mimura, et al., The influence of glycosylation on the thermal stability and effector function expression of human IgG1-Fc: properties of a series of truncated glycoforms, Mol Immunol., (2000) 37:697-706; Kwon, et al., Effect of glycosylation on the stability of alpha1-antitrypsin toward urea denaturation and thermal deactivation, Biochim Biophys.Acta, (1997) 1335:265-272; Wang, et al., pH dependent effect of glycosylation on protein stability, Eur J Pharm Sci, (2008) 33:120-127; Yamaguchi, et al., Glycoform-dependent conformational alteration of the Fc region of human immunoglobulin G1 as revealed by NMR spectroscopy, Biochim Biophys.Acta, (2006) 1760:693-700; Arnold, et al., The impact of glycosylation on the biological function and structure of human immunoglobulins, Annu Rev Immunol., (2007) 25:21-50; Zheng, et al., The impact of glycosylation on monoclonal antibody conformation and stability, MAbs., (2011) 3:568-576. The substitution N297K resulted in a site of transamidation, and utilizing this site also has the same disadvantage as the N297Q mutation.

The second approach involves engineering a 4-amino acid LLQG glutamine tag at either termini or within a solvent exposed region of the mAb. Strop, et al., Location matters: site of conjugation modulates stability and pharmacokinetics of antibody drug conjugates, Chem Biol, (2013) 20:161-167. The addition of 4 amino acids increases the likelihood of an immunogenic response in a patient which would reduce the efficacy of the ADC. In contrast, the modifications described herein utilize single amino acid substitutions or single amino acid, e.g., lysine, insertions as conjugation sites, thereby reducing the chance of eliciting an immune response in patients. Furthermore, multiple sites throughout the IgG, kappa, and lambda constant domains can be used if it is found that one site confers an undesirable property on the mAb such as increased aggregation or immunogenicity.

In summary, acyl acceptor sites can be engineeried in an antibody, or antigen binding fragment, by either insertion of a lysine between two native residues or by a lysine substitution at various positions throughout IgG1-4, kappa, or lambda. The optimal context for an acyl acceptor site is not only position-dependent, but also requires no acidic residue at the −1 or +1 position or no proline at the +1 position. Microbial transglutaminase conjugation technology can utilize these engineered sites to conjugate a variety of acyl donor-containing functional agents for making ADCs, bispecific antibodies, immunotoxins, or other mAb-protein complexes.

Those skilled in the art will appreciate that numerous changes and modifications can be made to the preferred embodiments of the invention and that such changes and modifications can be made without departing from the spirit of the invention. It is, therefore, intended that the appended claims cover all such equivalent variations as fall within the true spirit and scope of the invention.

SEQUENCE LISTING (339 sequences)

SEQ ID NO: 1 - protein, 231 aa, Artificial Sequence
  Synthetic: 4F3F-VH
QVQLQQSGPELEKPGASVKISCKASGYSFTGYTMNWVKQSHGKSLEWIGLITPYNGASSYNQKFRGKATLTVDKSSSTAYMDLLSLTSEDSAVYFCARGGYDGRGFDYWGSGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPC

SEQ ID NO: 2 - protein, 213 aa, Artificial Sequence
  Synthetic: 4F3F-VK
DIELTQSPAIMSASPGEKVTMTCSASSSVSYMHWYQQKSGTSPKRWIYDTSKLASGVPGRFSGSGSGNSYSLTISSVEAEDDATYYCQQWSKHPLTFGSGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3 - protein, 237 aa, Artificial Sequence
  Synthetic: 4HK0-VH
QVQLVQSGAEVKKPGASVKVSCKASGYTFTGYYMHWVRQAPGQGLEWMGWINPNSGGTNYAQKFQGWVTMTRDTSISTAYMELSRLRSDDTAVYYCARGGLEPRSVDYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKHHHHHH

SEQ ID NO: 4 - protein, 214 aa, Artificial Sequence
  Synthetic: 4HK0-VK
QSVLTQPPSVSVAPGQTARITCGGNNIGSKSVHWYQQKPGQAPVLVVYDDSDRPSGIPERFSGSNSGNTATLTISRVEAGDEADYYCQVWDSSSDHVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 5 - protein, 224 aa, Artificial Sequence
  Synthetic: 1FC1
THTCPPCPAPELLGGPSVFLFPPKPKDTLMISRTPEVTCVVVDVSHEDPQVKFNWYVDGVQVHNAKTKPREQQYNSTYRVVSVLTVLHQNWLDGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 6 - protein, 330 aa, Artificial Sequence [sequence omitted]

SEQ ID NO: 7 - protein, 107 aa, Artificial Sequence [sequence omitted]

SEQ ID NO: 8 - protein, 330 aa, Artificial Sequence
  Synthetic: Antibody 03HC
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGFFFLYSKLTVDKSRWQQGNVFSCSVMHEALHNHYTQKSLSLSPGK

SEQ ID NO: 9 - protein, 107 aa, Artificial Sequence [sequence omitted]

SEQ ID NO: 10 - protein, 330 aa, Artificial Sequence [sequence omitted]

SEQ ID NO: 11 - protein, 107 aa, Artificial Sequence [sequence omitted]

SEQ ID NO: 12 - protein, 330 aa, Artificial Sequence [sequence omitted]

SEQ ID NO: 13 - protein, 107 aa, Artificial Sequence [sequence omitted]

SEQ ID NO: 14 - protein, 330 aa, Artificial Sequence [sequence omitted]

SEQ ID NO: 15 - protein, 106 aa, Artificial Sequence
  Synthetic: Antibody 05LC
GQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 16 - protein, 330 aa, Artificial Sequence [sequence omitted]

SEQ ID NO: 17 - protein, 107 aa, Artificial Sequence [sequence omitted]

SEQ ID NO: 18 - protein, 330 aa, Artificial Sequence [sequence omitted]

SEQ ID NO: 19 - protein, 107 aa, Artificial Sequence [sequence omitted]

SEQ ID NO: 20 - protein, 106 aa, Artificial Sequence
  Synthetic: human lambda
GQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 21 - protein, 330 aa, Artificial Sequence
  Synthetic: Antibody 01HC-A118K
KSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 22 - protein, 330 aa, Artificial Sequence
  Synthetic: Antibody 01HC-S119K
AKTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 23 - protein, 330 aa, Artificial Sequence
  Synthetic: Antibody 01HC-T120K
ASKKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 24 - protein, 330 aa, Artificial Sequence
  Synthetic: Antibody 01HC-G122K
ASTKKPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 25 - protein, 330 aa, Artificial Sequence
  Synthetic: Antibody 01HC-S131K
ASTKGPSVFPLAPKSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 26 - protein, 330 aa, Artificial Sequence
  Synthetic: Antibody 01HC-S132K
ASTKGPSVFPLAPSKKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 27 - protein, 330 aa, Artificial Sequence
  Synthetic: Antibody 01HC-S134K
ASTKGPSVFPLAPSSKKTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 28 - protein, 330 aa, Artificial Sequence
  Synthetic: Antibody 01HC-T135K
ASTKGPSVFPLAPSSKSKSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 29 - protein, 330 aa, Artificial Sequence
  Synthetic: Antibody 01HC-S136K
ASTKGPSVFPLAPSSKSTKGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 30 - protein, 330 aa, Artificial Sequence
  Synthetic: Antibody 01HC-G137K
ASTKGPSVFPLAPSSKSTSKGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 31 - protein, 330 aa, Artificial Sequence
  Synthetic: Antibody 01HC-G138K
ASTKGPSVFPLAPSSKSTSGKTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 32 - protein, 330 aa, Artificial Sequence
  Synthetic: Antibody 01HC-T139K
ASTKGPSVFPLAPSSKSTSGGKAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 33 - protein, 330 aa, Artificial Sequence
  Synthetic: Antibody 01HC-E152K
ASTKGPSVFPLAPSSKSTSGGTAALGCLVKDYFPKPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 34 - protein, 330 aa, Artificial Sequence
  Synthetic: Antibody 01HC-P153K
ASTKGPSVFPLAPSSKSTSGGTAALGCLVKDYFPEKVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 35 - protein, 330 aa, Artificial Sequence
  Synthetic: Antibody 01HC-S160K
ASTKGPSVFPLAPSSKSTSGGTAALGCLVKDYFPEPVTVSWNKGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 36 - protein, 330 aa, Artificial Sequence
  Synthetic: Antibody 01HC-A162K
ASTKGPSVFPLAPSSKSTSGGTAALGCLVKDYFPEPVTVSWNSGKLTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 37 - protein, 330 aa, Artificial Sequence
  Synthetic: Antibody 01HC-L163K
ASTKGPSVFPLAPSSKSTSGGTAALGCLVKDYFPEPVTVSWNSGAKTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 38 - protein, 330 aa, Artificial Sequence
  Synthetic: Antibody 01HC-T164K
ASTKGPSVFPLAPSSKSTSGGTAALGCLVKDYFPEPVTVSWNSGALKSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 39 - protein, 330 aa, Artificial Sequence
  Synthetic: Antibody 01HC-S165K
ASTKGPSVFPLAPSSKSTSGGTAALGCLVKDYFPEPVTVSWNSGALTKGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 40 - protein, 330 aa, Artificial Sequence
  Synthetic: Antibody 01HC-G166K
ASTKGPSVFPLAPSSKSTSGGTAALGCLVKDYFPEPVTVSWNSGALTSKVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 41 - protein, 330 aa, Artificial Sequence
  Synthetic: Antibody 01HC-V167K
ASTKGPSVFPLAPSSKSTSGGTAALGCLVKDYFPEPVTVSWNSGALTSGKHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 42 - protein, 330 aa, Artificial Sequence
  Synthetic: Antibody 01HC-S176K
ASTKGPSVFPLAPSSKSTSGGTAALGCLVKDYFPEPVTVSWNSGALTSGVHTFPAVLQKSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 43 - protein, 330 aa, Artificial Sequence
  Synthetic: Antibody 01HC-S177K
ASTKGPSVFPLAPSSKSTSGGTAALGCLVKDYFPEPVTVSWNSGALTSGVHTFPAVLQSKGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 44 - protein, 330 aa, Artificial Sequence
  Synthetic: Antibody 01HC-G178K
ASTKGPSVFPLAPSSKSTSGGTAALGCLVKDYFPEPVTVSWNSGALTSGVHTFPAVLQSSKLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 45 - protein, 330 aa, Artificial Sequence
  Synthetic: Antibody 01HC-L179K
ASTKGPSVFPLAPSSKSTSGGTAALGCLVKDYFPEPVTVSWNSGALTSGVHTFPAVLQSSGKYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 46 - protein, 330 aa, Artificial Sequence
  Synthetic: Antibody 01HC-P189K
ASTKGPSVFPLAPSSKSTSGGTAALGCLVKDYFPEPVTVSWNSGALTSGVHTFPAVLQSSGLYSLSSVVTVKSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 47 - protein, 330 aa, Artificial Sequence
  Synthetic: Antibody 01HC-S190K
ASTKGPSVFPLAPSSKSTSGGTAALGCLVKDYFPEPVTVSWNSGALTSGVHTFPAVLQSSGLYSLSSVVTVPKSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 48 - protein, 330 aa, Artificial Sequence
  Synthetic: Antibody 01HC-S191K
ASTKGPSVFPLAPSSKSTSGGTAALGCLVKDYFPEPVTVSWNSGALTSGVHTFPAVLQSSGLYSLSSVVTVPSKSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 49 - protein, 330 aa, Artificial Sequence
  Synthetic: Antibody 01HC-S192K
ASTKGPSVFPLAPSSKSTSGGTAALGCLVKDYFPEPVTVSWNSGALTSGVHTFPAVLQSSGLYSLSSVVTVPSSKLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 50 - protein, 330 aa, Artificial Sequence
  Synthetic: Antibody 01HC-L193K
ASTKGPSVFPLAPSSKSTSGGTAALGCLVKDYFPEPVTVSWNSGALTSGVHTFPAVLQSSGLYSLSSVVTVPSSSKGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 51 - protein, 330 aa, Artificial Sequence
  Synthetic: Antibody 01HC-G194K
ASTKGPSVFPLAPSSKSTSGGTAALGCLVKDYFPEPVTVSWNSGALTSGVHTFPAVLQSSGLYSLSSVVTVPSSSLKTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 52 - protein, 330 aa, Artificial Sequence
  Synthetic: Antibody 01HC-T195K
ASTKGPSVFPLAPSSKSTSGGTAALGCLVKDYFPEPVTVSWNSGALTSGVHTFPAVLQSSGLYSLSSVVTVPSSSLGKQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 53 - protein, 330 aa, Artificial Sequence
  Synthetic: Antibody 01HC-Q196K
ASTKGPSVFPLAPSSKSTSGGTAALGCLVKDYFPEPVTVSWNSGALTSGVHTFPAVLQSSGLYSLSSVVTVPSSSLGTKTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 54 - protein, 330 aa, Artificial Sequence
  Synthetic: Antibody 01HC-T197K
ASTKGPSVFPLAPSSKSTSGGTAALGCLVKDYFPEPVTVSWNSGALTSGVHTFPAVLQSSGLYSLSSVVTVPSSSLGTQKYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 55 - protein, 330 aa, Artificial Sequence
  Synthetic: Antibody 01HC-P206K
ASTKGPSVFPLAPSSKSTSGGTAALGCLVKDYFPEPVTVSWNSGALTSGVHTFPAVLQSSGLYSLSSVVTVPSSSLGTQTYICNVNHKKSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 56 - protein, 330 aa, Artificial Sequence
  Synthetic: Antibody 01HC-S207K
ASTKGPSVFPLAPSSKSTSGGTAALGCLVKDYFPEPVTVSWNSGALTSGVHTFPAVLQSSGLYSLSSVVTVPSSSLGTQTYICNVNHKPKNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 57 - protein, 330 aa, Artificial Sequence
  Synthetic: Antibody 01HC-E216K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVKPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 58 - protein, 330 aa, Artificial Sequence
  Synthetic: Antibody 01HC-P217K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEKKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 59 - protein, 330 aa, Artificial Sequence
  Synthetic: Antibody 01HC-S219K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKKCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 60 - protein, 330 aa, Artificial Sequence
  Synthetic: Antibody 01HC-D221K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCKKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 61 - protein, 330 aa, Artificial Sequence
  Synthetic: Antibody 01HC-T223K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKKHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 62 - protein, 330 aa, Artificial Sequence
  Synthetic: Antibody 01HC-H224K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTKTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 63 - protein, 330 aa, Artificial Sequence
  Synthetic: Antibody 01HC-T225K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHKCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 64 - protein, 330 aa, Artificial Sequence
  Synthetic: Antibody 01HC-C226K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTKPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 65 - protein, 330 aa, Artificial Sequence
  Synthetic: Antibody 01HC-P227K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCKPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 66 - protein, 330 aa, Artificial Sequence
  Synthetic: Antibody 01HC-P228K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPKCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 67 - protein, 330 aa, Artificial Sequence
  Synthetic: Antibody 01HC-C229K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPKPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 68 - protein, 330 aa, Artificial Sequence
  Synthetic: Antibody 01HC-P230K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCKAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 69 - protein, 330 aa, Artificial Sequence
  Synthetic: Antibody 01HC-A231K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPKPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 70 - protein, 330 aa, Artificial Sequence
  Synthetic: Antibody 01HC-P232K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAKELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 71 - protein, 330 aa, Artificial Sequence
  Synthetic: Antibody 01HC-E233K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPKLLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 72 - protein, 330 aa, Artificial Sequence
  Synthetic: Antibody 01HC-L234K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEKLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 73 - protein, 330 aa, Artificial Sequence
  Synthetic: Antibody 01HC-L235K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELKGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 74 - protein, 330 aa, Artificial Sequence
  Synthetic: Antibody 01HC-G236K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLKGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 75 - protein, 330 aa, Artificial Sequence
  Synthetic: Antibody 01HC-G237K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGKPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 76 - protein, 330 aa, Artificial Sequence
  Synthetic: Antibody 01HC-P247K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKKKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 77 - protein, 330 aa, Artificial Sequence
  Synthetic: Antibody 01HC-M252K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLKISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 78 - protein, 330 aa, Artificial Sequence
  Synthetic: Antibody 01HC-I253K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMKSRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 79 - protein, 330 aa, Artificial Sequence
  Synthetic: Antibody 01HC-S254K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMIKRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 80 - protein, 330 aa, Artificial Sequence
  Synthetic: Antibody 01HC-R255K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISKTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 81 - protein, 330 aa, Artificial Sequence
  Synthetic: Antibody 01HC-T256K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRKPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 82 - protein, 330 aa, Artificial Sequence
  Synthetic: Antibody 01HC-D265K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVKVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 83 - protein, 330 aa, Artificial Sequence
  Synthetic: Antibody 01HC-S267K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 84 - protein, 330 aa, Artificial Sequence
  Synthetic: Antibody 01HC-H268K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSKEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 85 - protein, 330 aa, Artificial Sequence
  Synthetic: Antibody 01HC-E269K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHKDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 86 - protein, 330 aa, Artificial Sequence
  Synthetic: Antibody 01HC-D270K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEKPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 87 - protein, 330 aa, Artificial Sequence
  Synthetic: Antibody 01HC-P271K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDKEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 88 - protein, 330 aa, Artificial Sequence
  Synthetic: Antibody 01HC-E272K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPKVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 89 - protein, 330 aa, Artificial Sequence
  Synthetic: Antibody 01HC-D280K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVKGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 90 - protein, 330 aa, Artificial Sequence
  Synthetic: Antibody 01HC-G281K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDKVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 91 - protein, 330 aa, Artificial Sequence
  Synthetic: Antibody 01HC-V282K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGKEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 92 - protein, 330 aa, Artificial Sequence
  Synthetic: Antibody 01HC-E283K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVKVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 93 - protein, 330 aa, Artificial Sequence
  Synthetic: Antibody 01HC-V284K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEKHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 94 - protein, 330 aa, Artificial Sequence
  Synthetic: Antibody 01HC-H285K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVKNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 95 - protein, 330 aa, Artificial Sequence
  Synthetic: Antibody 01HC-N286K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHKAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 96 - protein, 330 aa, Artificial Sequence
  Synthetic: Antibody 01HC-A287K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNKKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 97 - protein, 330 aa, Artificial Sequence
  Synthetic: Antibody 01HC-T289K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKKKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 98 - protein, 330 aa, Artificial Sequence
  Synthetic: Antibody 01HC-Q295K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEKYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 99 - protein, 330 aa, Artificial Sequence
  Synthetic: Antibody 01HC-Y296K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQKNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 100 - protein, 330 aa, Artificial Sequence
  Synthetic: Antibody 01HC-N297K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYKSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 101 - protein, 330 aa, Artificial Sequence
  Synthetic: Antibody 01HC-S298K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNKTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 102 - protein, 330 aa, Artificial Sequence
  Synthetic: Antibody 01HC-L309K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVKHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 103 - protein, 330 aa, Artificial Sequence
  Synthetic: Antibody 01HC-H310K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLKQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 104 - protein, 330 aa, Artificial Sequence
  Synthetic: Antibody 01HC-Q311K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHKDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 105 - protein, 330 aa, Artificial Sequence
  Synthetic: Antibody 01HC-D312K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQKWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 106 - protein, 330 aa, Artificial Sequence
  Synthetic: Antibody 01HC-L314K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWKNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 107 - protein, 330 aa, Artificial Sequence
  Synthetic: Antibody 01HC-N315K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLKGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 108 - protein, 330 aa, Artificial Sequence
  Synthetic: Antibody 01HC-G316K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNKKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 109 - protein, 330 aa, Artificial Sequence
  Synthetic: Antibody 01HC-E318K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKKYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 110 - protein, 330 aa, Artificial Sequence
  Synthetic: Antibody 01HC-A327K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKKLPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 111 - protein, 330 aa, Artificial Sequence
  Synthetic: Antibody 01HC-P329K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 112 - protein, 330 aa, Artificial Sequence
  Synthetic: Antibody 01HC-A330K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPKPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 113 - protein, 330 aa, Artificial Sequence
  Synthetic: Antibody 01HC-P331K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAKIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 114 - protein, 330 aa, Artificial Sequence
  Synthetic: Antibody 01HC-S337K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTIKKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 115 - protein, 330 aa, Artificial Sequence
  Synthetic: Antibody 01HC-A339K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKKKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 116 - protein, 330 aa, Artificial Sequence
  Synthetic: Antibody 01HC-G341K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKKQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 117 - protein, 330 aa, Artificial Sequence
  Synthetic: Antibody 01HC-Q342K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGKPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 118 - protein, 330 aa, Artificial Sequence
  Synthetic: Antibody 01HC-P343K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQKREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 119 - protein, 330 aa, Artificial Sequence
  Synthetic: Antibody 01HC-R344K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPKEPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 120 - protein, 330 aa, Artificial Sequence
  Synthetic: Antibody 01HC-E345K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPRKPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 121 - protein, 330 aa, Artificial Sequence
  Synthetic: Antibody 01HC-R355K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSKDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 122 - protein, 330 aa, Artificial Sequence
  Synthetic: Antibody 01HC-D356K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRKELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 123 - protein, 330 aa, Artificial Sequence
  Synthetic: Antibody 01HC-L358K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDEKTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 124 - protein, 330 aa, Artificial Sequence
  Synthetic: Antibody 01HC-T359K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELKKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 125 - protein, 330 aa, Artificial Sequence
  Synthetic: Antibody 01HC-N361K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKKQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 126 - protein, 330 aa, Artificial Sequence
  Synthetic: Antibody 01HC-Q362K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNKVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 127 - protein, 330 aa, Artificial Sequence
  Synthetic: Antibody 01HC-S375K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPKDIAVEWESNGQPENNYKTTPPVLDSDGSFFLYSKLTVDKSRWQQGNVFSCSVMHEALHNHYTQKSLSLSPGK

SEQ ID NO: 128 - protein, 330 aa, Artificial Sequence
  Synthetic: Antibody 01HC-D376K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSKIAVEWESNGQPENNYKTTPPVLDSDGSFFLYSKLTVDKSRWQQGNVFSCSVMHEALHNHYTQKSLSLSPGK

SEQ ID NO: 129 - protein, 330 aa, Artificial Sequence
  Synthetic: Antibody 01HC-E382K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWKSNGQPENNYKTTPPVLDSDGSFFLYSKLTVDKSRWQQGNVFSCSVMHEALHNHYTQKSLSLSPGK

SEQ ID NO: 130 - protein, 330 aa, Artificial Sequence
  Synthetic: Antibody 01HC-N384K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESKGQPENNYKTTPPVLDSDGSFFLYSKLTVDKSRWQQGNVFSCSVMHEALHNHYTQKSLSLSPGK

SEQ ID NO: 131 - protein, 330 aa, Artificial Sequence
  Synthetic: Antibody 01HC-G385K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNKQPENNYKTTPPVLDSDGSFFLYSKLTVDKSRWQQGNVFSCSVMHEALHNHYTQKSLSLSPGK

SEQ ID NO: 132 - protein, 330 aa, Artificial Sequence
  Synthetic: Antibody 01HC-Q386K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGKPENNYKTTPPVLDSDGSFFLYSKLTVDKSRWQQGNVFSCSVMHEALHNHYTQKSLSLSPGK

SEQ ID NO: 133 - protein, 330 aa, Artificial Sequence
  Synthetic: Antibody 01HC-P387K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQKENNYKTTPPVLDSDGSFFLYSKLTVDKSRWQQGNVFSCSVMHEALHNHYTQKSLSLSPGK

SEQ ID NO: 134 - protein, 330 aa, Artificial Sequence
  Synthetic: Antibody 01HC-N389K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPEKNYKTTPPVLDSDGSFFLYSKLTVDKSRWQQGNVFSCSVMHEALHNHYTQKSLSLSPGK

SEQ ID NO: 135 - protein, 330 aa, Artificial Sequence
  Synthetic: Antibody 01HC-N390K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENKYKTTPPVLDSDGSFFLYSKLTVDKSRWQQGNVFSCSVMHEALHNHYTQKSLSLSPGK

SEQ ID NO: 136 - protein, 330 aa, Artificial Sequence
  Synthetic: Antibody 01HC-L398K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVKDSDGSFFLYSKLTVDKSRWQQGNVFSCSVMHEALHNHYTQKSLSLSPGK

SEQ ID NO: 137 - protein, 330 aa, Artificial Sequence
  Synthetic: Antibody 01HC-S400K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDKDGSFFLYSKLTVDKSRWQQGNVFSCSVMHEALHNHYTQKSLSLSPGK

SEQ ID NO: 138 - protein, 330 aa, Artificial Sequence
  Synthetic: Antibody 01HC-D401K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSKGSFFLYSKLTVDKSRWQQGNVFSCSVMHEALHNHYTQKSLSLSPGK

SEQ ID NO: 139 - protein, 330 aa, Artificial Sequence
  Synthetic: Antibody 01HC-G402K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDKSFFLYSKLTVDKSRWQQGNVFSCSVMHEALHNHYTQKSLSLSPGK

SEQ ID NO: 140 - protein, 330 aa, Artificial Sequence
  Synthetic: Antibody 01HC-D413K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVKKSRWQQGNVFSCSVMHEALHNHYTQKSLSLSPGK

SEQ ID NO: 141 - protein, 330 aa, Artificial Sequence
  Synthetic: Antibody 01HC-S415K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKKRWQQGNVFSCSVMHEALHNHYTQKSLSLSPGK

SEQ ID NO: 142 - protein, 330 aa, Artificial Sequence
  Synthetic: Antibody 01HC-R416K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSKWQQGNVFSCSVMHEALHNHYTQKSLSLSPGK

SEQ ID NO: 143 - protein, 330 aa, Artificial Sequence
  Synthetic: Antibody 01HC-Q418K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWKQGNVFSCSVMHEALHNHYTQKSLSLSPGK

SEQ ID NO: 144 - protein, 330 aa, Artificial Sequence
  Synthetic: Antibody 01HC-Q419K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQKGNVFSCSVMHEALHNHYTQKSLSLSPGK

SEQ ID NO: 145 - protein, 330 aa, Artificial Sequence
  Synthetic: Antibody 01HC-G420K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQKNVFSCSVMHEALHNHYTQKSLSLSPGK

SEQ ID NO: 146 - protein, 330 aa, Artificial Sequence
  Synthetic: Antibody 01HC-N421K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGKVFSCSVMHEALHNHYTQKSLSLSPGK

SEQ ID NO: 147 - protein, 330 aa, Artificial Sequence
  Synthetic: Antibody 01HC-V422K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNKFSCSVMHEALHNHYTQKSLSLSPGK

SEQ ID NO: 148 - protein, 330 aa, Artificial Sequence
  Synthetic: Antibody 01HC-A431K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEKLHNHYTQKSLSLSPGK

SEQ ID NO: 149 - protein, 330 aa, Artificial Sequence
  Synthetic: Antibody 01HC-H433K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALKNHYTQKSLSLSPGK

SEQ ID NO: 150 - protein, 330 aa, Artificial Sequence
  Synthetic: Antibody 01HC-N434K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHKHYTQKSLSLSPGK

SEQ ID NO: 151 - protein, 330 aa, Artificial Sequence
  Synthetic: Antibody 01HC-H435K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNKYTQKSLSLSPGK

SEQ ID NO: 152 - protein, 330 aa, Artificial Sequence
  Synthetic: Antibody 01HC-Y436K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHKTQKSLSLSPGK

SEQ ID NO: 153 - protein, 330 aa, Artificial Sequence
  Synthetic: Antibody 01HC-S442K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLKLSPGK

SEQ ID NO: 154 - protein, 330 aa, Artificial Sequence
  Synthetic: Antibody 01HC-L443K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSKSPGK

SEQ ID NO: 155 - protein, 330 aa, Artificial Sequence
  Synthetic: Antibody 01HC-S444K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLKPGK

SEQ ID NO: 156 - protein, 330 aa, Artificial Sequence
  Synthetic: Antibody 01HC-P445K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSKGK

SEQ ID NO: 157 - protein, 330 aa, Artificial Sequence
  Synthetic: Antibody 01HC-G446K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPKK

SEQ ID NO: 158 - protein, 107 aa, Artificial Sequence
  Synthetic: Antibody 01LC-R108K
KTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 159 - protein, 107 aa, Artificial Sequence
  Synthetic: Antibody 01LC-T109K
RKVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 160 - protein, 107 aa, Artificial Sequence
  Synthetic: Antibody 01LC-V110K
RTKAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 161 - protein, 107 aa, Artificial Sequence
  Synthetic: Antibody 01LC-A112K
RTVAKPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 162 - protein, 107 aa, Artificial Sequence
  Synthetic: Antibody 01LC-D122K
RTVAAPSVFIFPPSKEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 163 - protein, 107 aa, Artificial Sequence
  Synthetic: Antibody 01LC-E123K
RTVAAPSVFIFPPSDKQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 164 - protein, 107 aa, Artificial Sequence
  Synthetic: Antibody 01LC-S127K
RTVAAPSVFIFPPSDEQLKKGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 165 - protein, 107 aa, Artificial Sequence
  Synthetic: Antibody 01LC-G128K
RTVAAPSVFIFPPSDEQLKSKTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 166 - protein, 107 aa, Artificial Sequence
  Synthetic: Antibody 01LC-T129K
RTVAAPSVFIFPPSDEQLKSGKASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 167 - protein, 107 aa, Artificial Sequence
  Synthetic: Antibody 01LC-R142K
RTVAAPSVFIFPPSDEQLKSGTASVVCLLNNFYPKEAKVQWKVDNALQSGNSQESVTEQDSKDSTYSLSSTLTLSKADYEKHKVYACEVTHQGLSSPVTKSFNRGEC

SEQ ID NO: 168 - protein, 107 aa, Artificial Sequence
  Synthetic: Antibody 01LC-E143K
RTVAAPSVFIFPPSDEQLKSGTASVVCLLNNFYPRKAKVQWKVDNALQSGNSQESVTEQDSKDSTYSLSSTLTLSKADYEKHKVYACEVTHQGLSSPVTKSFNRGEC

SEQ ID NO: 169 - protein, 107 aa, Artificial Sequence
  Synthetic: Antibody 01LC-D151K
RTVAAPSVFIFPPSDEQLKSGTASVVCLLNNFYPREAKVQWKVKNALQSGNSQESVTEQDSKDSTYSLSSTLTLSKADYEKHKVYACEVTHQGLSSPVTKSFNRGEC

SEQ ID NO: 170 - protein, 107 aa, Artificial Sequence
  Synthetic: Antibody 01LC-N152K
RTVAAPSVFIFPPSDEQLKSGTASVVCLLNNFYPREAKVQWKVDKALQSGNSQESVTEQDSKDSTYSLSSTLTLSKADYEKHKVYACEVTHQGLSSPVTKSFNRGEC

SEQ ID NO: 171 - protein, 107 aa, Artificial Sequence
  Synthetic: Antibody 01LC-A153K
RTVAAPSVFIFPPSDEQLKSGTASVVCLLNNFYPREAKVQWKVDNKLQSGNSQESVTEQDSKDSTYSLSSTLTLSKADYEKHKVYACEVTHQGLSSPVTKSFNRGEC

SEQ ID NO: 172 - protein, 107 aa, Artificial Sequence
  Synthetic: Antibody 01LC-L154K
RTVAAPSVFIFPPSDEQLKSGTASVVCLLNNFYPREAKVQWKVDNAKQSGNSQESVTEQDSKDSTYSLSSTLTLSKADYEKHKVYACEVTHQGLSSPVTKSFNRGEC

SEQ ID NO: 173 - protein, 107 aa, Artificial Sequence
  Synthetic: Antibody 01LC-Q155K
RTVAAPSVFIFPPSDEQLKSGTASVVCLLNNFYPREAKVQWKVDNALKSGNSQESVTEQDSKDSTYSLSSTLTLSKADYEKHKVYACEVTHQGLSSPVTKSFNRGEC

SEQ ID NO: 174 - protein, 107 aa, Artificial Sequence
  Synthetic: Antibody 01LC-S156K
RTVAAPSVFIFPPSDEQLKSGTASVVCLLNNFYPREAKVQWKVDNALQKGNSQESVTEQDSKDSTYSLSSTLTLSKADYEKHKVYACEVTHQGLSSPVTKSFNRGEC

SEQ ID NO: 175 - protein, 107 aa, Artificial Sequence
  Synthetic: Antibody 01LC-G157K
RTVAAPSVFIFPPSDEQLKSGTASVVCLLNNFYPREAKVQWKVDNALQSKNSQESVTEQDSKDSTYSLSSTLTLSKADYEKHKVYACEVTHQGLSSPVTKSFNRGEC

SEQ ID NO: 176 - protein, 107 aa, Artificial Sequence
  Synthetic: Antibody 01LC-E165K
RTVAAPSVFIFPPSDEQLKSGTASVVCLLNNFYPREAKVQWKVDNALQSGNSQESVTKQDSKDSTYSLSSTLTLSKADYEKHKVYACEVTHQGLSSPVTKSFNRGEC

SEQ ID NO: 177 - protein, 107 aa, Artificial Sequence
  Synthetic: Antibody 01LC-D167K
RTVAAPSVFIFPPSDEQLKSGTASVVCLLNNFYPREAKVQWKVDNALQSGNSQESVTEQKSKDSTYSLSSTLTLSKADYEKHKVYACEVTHQGLSSPVTKSFNRGEC

SEQ ID NO: 178 - protein, 107 aa, Artificial Sequence
  Synthetic: Antibody 01LC-S168K
RTVAAPSVFIFPPSDEQLKSGTASVVCLLNNFYPREAKVQWKVDNALQSGNSQESVTEQDKKDSTYSLSSTLTLSKADYEKHKVYACEVTHQGLSSPVTKSFNRGEC

SEQ ID NO: 179 - protein, 107 aa, Artificial Sequence
  Synthetic: Antibody 01LC-D170K
RTVAAPSVFIFPPSDEQLKSGTASVVCLLNNFYPREAKVQWKVDNALQSGNSQESVTEQDSKKSTYSLSSTLTLSKADYEKHKVYACEVTHQGLSSPVTKSFNRGEC

SEQ ID NO: 180 - protein, 107 aa, Artificial Sequence
  Synthetic: Antibody 01LC-S182K
RTVAAPSVFIFPPSDEQLKSGTASVVCLLNNFYPREAKVQWKVDNALQSGNSQESVTEQDSKDSTYSLSSTLTLKKADYEKHKVYACEVTHQGLSSPVTKSFNRGEC

SEQ ID NO: 181 - protein, 107 aa, Artificial Sequence
  Synthetic: Antibody 01LC-A184K
RTVAAPSVFIFPPSDEQLKSGTASVVCLLNNFYPREAKVQWKVDNALQSGNSQESVTEQDSKDSTYSLSSTLTLSKKDYEKHKVYACEVTHQGLSSPVTKSFNRGEC

SEQ ID NO: 182 - protein, 107 aa, Artificial Sequence
  Synthetic: Antibody 01LC-E187K
RTVAAPSVFIFPPSDEQLKSGTASVVCLLNNFYPREAKVQWKVDNALQSGNSQESVTEQDSKDSTYSLSSTLTLSKADYKKHKVYACEVTHQGLSSPVTKSFNRGEC

SEQ ID NO: 183 - protein, 107 aa, Artificial Sequence
  Synthetic: Antibody 01LC-H189K
RTVAAPSVFIFPPSDEQLKSGTASVVCLLNNFYPREAKVQWKVDNALQSGNSQESVTEQDSKDSTYSLSSTLTLSKADYEKKKVYACEVTHQGLSSPVTKSFNRGEC

SEQ ID NO: 184 - protein, 107 aa, Artificial Sequence
  Synthetic: Antibody 01LC-V191K
RTVAAPSVFIFPPSDEQLKSGTASVVCLLNNFYPREAKVQWKVDNALQSGNSQESVTEQDSKDSTYSLSSTLTLSKADYEKHKKYACEVTHQGLSSPVTKSFNRGEC

SEQ ID NO: 185 - protein, 107 aa, Artificial Sequence
  Synthetic: Antibody 01LC-Q199K
RTVAAPSVFIFPPSDEQLKSGTASVVCLLNNFYPREAKVQWKVDNALQSGNSQESVTEQDSKDSTYSLSSTLTLSKADYEKHKVYACEVTHKGLSSPVTKSFNRGEC

SEQ ID NO: 186 - protein, 107 aa, Artificial Sequence
  Synthetic: Antibody 01LC-G200K
RTVAAPSVFIFPPSDEQLKSGTASVVCLLNNFYPREAKVQWKVDNALQSGNSQESVTEQDSKDSTYSLSSTLTLSKADYEKHKVYACEVTHQKLSSPVTKSFNRGEC

SEQ ID NO: 187 - protein, 107 aa, Artificial Sequence
  Synthetic: Antibody 01LC-L201K
RTVAAPSVFIFPPSDEQLKSGTASVVCLLNNFYPREAKVQWKVDNALQSGNSQESVTEQDSKDSTYSLSSTLTLSKADYEKHKVYACEVTHQGKSSPVTKSFNRGEC

SEQ ID NO: 188 - protein, 107 aa, Artificial Sequence
  Synthetic: Antibody 01LC-S202K
RTVAAPSVFIFPPSDEQLKSGTASVVCLLNNFYPREAKVQWKVDNALQSGNSQESVTEQDSKDSTYSLSSTLTLSKADYEKHKVYACEVTHQGLKSPVTKSFNRGEC

SEQ ID NO: 189 - protein, 107 aa, Artificial Sequence
  Synthetic: Antibody 01LC-S203K
RTVAAPSVFIFPPSDEQLKSGTASVVCLLNNFYPREAKVQWKVDNALQSGNSQESVTEQDSKDSTYSLSSTLTLSKADYEKHKVYACEVTHQGLSKPVTKSFNRGEC

SEQ ID NO: 190 - protein, 107 aa, Artificial Sequence
  Synthetic: Antibody 01LC-P204K
RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSKVTKSFNRGEC

SEQ ID NO: 191 - protein, 107 aa, Artificial Sequence
  Synthetic: Antibody 01LC-N210K
RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFKRGEC

SEQ ID NO: 192 - protein, 107 aa, Artificial Sequence
  Synthetic: Antibody 01LC-R211K
RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNKGEC

SEQ ID NO: 193 - protein, 107 aa, Artificial Sequence
  Synthetic: Antibody 01LC-G212K
RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRKEC

SEQ ID NO: 194 - protein, 107 aa, Artificial Sequence
  Synthetic: Antibody 01LC-E213K
RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGKC

SEQ ID NO: 195 - protein, 106 aa, Artificial Sequence
  Synthetic: Antibody 05LC-G110K
KQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 196 - protein, 106 aa, Artificial Sequence
  Synthetic: Antibody 05LC-Q111K
GKPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 197 - protein, 106 aa, Artificial Sequence
  Synthetic: Antibody 05LC-P112K
GQKKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 198 - protein, 106 aa, Artificial Sequence
  Synthetic: Antibody 05LC-A115K
GQPKAKPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 199 - protein, 106 aa, Artificial Sequence
  Synthetic: Antibody 05LC-S125K
GQPKAAPSVTLFPPSKEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 200 - protein, 106 aa, Artificial Sequence
  Synthetic: Antibody 05LC-E126K
GQPKAAPSVTLFPPSSKELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 201 - protein, 106 aa, Artificial Sequence
  Synthetic: Antibody 05LC-L128K
GQPKAAPSVTLFPPSSEEKQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 202 - protein, 106 aa, Artificial Sequence
  Synthetic: Antibody 05LC-Q129K
GQPKAAPSVTLFPPSSEELKANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 203 - protein, 106 aa, Artificial Sequence
  Synthetic: Antibody 05LC-A130K
GQPKAAPSVTLFPPSSEELQKNKATLVCLISDFYPGAVTVAWKADSSPVKAGVETTTPSKQSNNKYAASSYLSLTPEQWKSHRSYSCQVTHEGSTVEKTVAPTECS

SEQ ID NO: 204 - protein, 106 aa, Artificial Sequence
  Synthetic: Antibody 05LC-N131K
GQPKAAPSVTLFPPSSEELQAKKATLVCLISDFYPGAVTVAWKADSSPVKAGVETTTPSKQSNNKYAASSYLSLTPEQWKSHRSYSCQVTHEGSTVEKTVAPTECS

SEQ ID NO: 205 - protein, 106 aa, Artificial Sequence
  Synthetic: Antibody 05LC-G145K
GQPKAAPSVTLFPPSSEELQANKATLVCLISDFYPKAVTVAWKADSSPVKAGVETTTPSKQSNNKYAASSYLSLTPEQWKSHRSYSCQVTHEGSTVEKTVAPTECS

SEQ ID NO: 206 - protein, 106 aa, Artificial Sequence
  Synthetic: Antibody 05LC-A146K
GQPKAAPSVTLFPPSSEELQANKATLVCLISDFYPGKVTVAWKADSSPVKAGVETTTPSKQSNNKYAASSYLSLTPEQWKSHRSYSCQVTHEGSTVEKTVAPTECS

SEQ ID NO: 207 - protein, 106 aa, Artificial Sequence
  Synthetic: Antibody 05LC-V147K
GQPKAAPSVTLFPPSSEELQANKATLVCLISDFYPGAKTVAWKADSSPVKAGVETTTPSKQSNNKYAASSYLSLTPEQWKSHRSYSCQVTHEGSTVEKTVAPTECS

SEQ ID NO: 208 - protein, 106 aa, Artificial Sequence
  Synthetic: Antibody 05LC-S155K
GQPKAAPSVTLFPPSSEELQANKATLVCLISDFYPGAVTVAWKADKSPVKAGVETTTPSKQSNNKYAASSYLSLTPEQWKSHRSYSCQVTHEGSTVEKTVAPTECS

SEQ ID NO: 209 - protein, 106 aa, Artificial Sequence
  Synthetic: Antibody 05LC-S156K
GQPKAAPSVTLFPPSSEELQANKATLVCLISDFYPGAVTVAWKADSKPVKAGVETTTPSKQSNNKYAASSYLSLTPEQWKSHRSYSCQVTHEGSTVEKTVAPTECS

SEQ ID NO: 210 - protein, 106 aa, Artificial Sequence
  Synthetic: Antibody 05LC-P157K
GQPKAAPSVTLFPPSSEELQANKATLVCLISDFYPGAVTVAWKADSSKVKAGVETTTPSKQSNNKYAASSYLSLTPEQWKSHRSYSCQVTHEGSTVEKTVAPTECS

SEQ ID NO: 211 - protein, 106 aa, Artificial Sequence
  Synthetic: Antibody 05LC-A160K
GQPKAAPSVTLFPPSSEELQANKATLVCLISDFYPGAVTVAWKADSSPVKKGVETTTPSKQSNNKYAASSYLSLTPEQWKSHRSYSCQVTHEGSTVEKTVAPTECS

SEQ ID NO: 212 - protein, 106 aa, Artificial Sequence
  Synthetic: Antibody 05LC-G161K
GQPKAAPSVTLFPPSSEELQANKATLVCLISDFYPGAVTVAWKADSSPVKAKVETTTPSKQSNNKYAASSYLSLTPEQWKSHRSYSCQVTHEGSTVEKTVAPTECS

SEQ ID NO: 213 - protein, 106 aa, Artificial Sequence
  Synthetic: Antibody 05LC-S171K
GQPKAAPSVTLFPPSSEELQANKATLVCLISDFYPGAVTVAWKADSSPVKAGVETTTPSKQKNNKYAASSYLSLTPEQWKSHRSYSCQVTHEGSTVEKTVAPTECS

SEQ ID NO: 214 - protein, 106 aa, Artificial Sequence
  Synthetic: Antibody 05LC-N172K
GQPKAAPSVTLFPPSSEELQANKATLVCLISDFYPGAVTVAWKADSSPVKAGVETTTPSKQSKNKYAASSYLSLTPEQWKSHRSYSCQVTHEGSTVEKTVAPTECS

SEQ ID NO: 215 - protein, 106 aa, Artificial Sequence
  Synthetic: Antibody 05LC-N173K
GQPKAAPSVTLFPPSSEELQANKATLVCLISDFYPGAVTVAWKADSSPVKAGVETTTPSKQSNKKYAASSYLSLTPEQWKSHRSYSCQVTHEGSTVEKTVAPTECS

SEQ ID NO: 216 - protein, 106 aa, Artificial Sequence
  Synthetic: Antibody 05LC-T184K
GQPKAAPSVTLFPPSSEELQANKATLVCLISDFYPGAVTVAWKADSSPVKAGVETTTPSKQSNNKYAASSYLSLKPEQWKSHRSYSCQVTHEGSTVEKTVAPTECS

SEQ ID NO: 217 - protein, 106 aa, Artificial Sequence
  Synthetic: Antibody 05LC-E186K
GQPKAAPSVTLFPPSSEELQANKATLVCLISDFYPGAVTVAWKADSSPVKAGVETTTPSKQSNNKYAASSYLSLTPKQWKSHRSYSCQVTHEGSTVEKTVAPTECS

SEQ ID NO: 218 - protein, 106 aa, Artificial Sequence
  Synthetic: Antibody 05LC-Q187K
GQPKAAPSVTLFPPSSEELQANKATLVCLISDFYPGAVTVAWKADSSPVKAGVETTTPSKQSNNKYAASSYLSLTPEKWKSHRSYSCQVTHEGSTVEKTVAPTECS

SEQ ID NO: 219 - protein, 106 aa, Artificial Sequence
  Synthetic: Antibody 05LC-S190K
GQPKAAPSVTLFPPSSEELQANKATLVCLISDFYPGAVTVAWKADSSPVKAGVETTTPSKQSNNKYAASSYLSLTPEQWKKHRSYSCQVTHEGSTVEKTVAPTECS

SEQ ID NO: 220 - protein, 106 aa, Artificial Sequence
  Synthetic: Antibody 05LC-H191K
GQPKAAPSVTLFPPSSEELQANKATLVCLISDFYPGAVTVAWKADSSPVKAGVETTTPSKQSNNKYAASSYLSLTPEQWKSKRSYSCQVTHEGSTVEKTVAPTECS

SEQ ID NO: 221 - protein, 106 aa, Artificial Sequence
  Synthetic: Antibody 05LC-E201K
GQPKAAPSVTLFPPSSEELQANKATLVCLISDFYPGAVTVAWKADSSPVKAGVETTTPSKQSNNKYAASSYLSLTPEQWKSHRSYSCQVTHKGSTVEKTVAPTECS

SEQ ID NO: 222 - protein, 106 aa, Artificial Sequence
  Synthetic: Antibody 05LC-G202K
GQPKAAPSVTLFPPSSEELQANKATLVCLISDFYPGAVTVAWKADSSPVKAGVETTTPSKQSNNKYAASSYLSLTPEQWKSHRSYSCQVTHEKSTVEKTVAPTECS

SEQ ID NO: 223 - protein, 106 aa, Artificial Sequence
  Synthetic: Antibody 05LC-S203K
GQPKAAPSVTLFPPSSEELQANKATLVCLISDFYPGAVTVAWKADSSPVKAGVETTTPSKQSNNKYAASSYLSLTPEQWKSHRSYSCQVTHEGKTVEKTVAPTECS

SEQ ID NO: 224 - protein, 106 aa, Artificial Sequence
  Synthetic: Antibody 05LC-P211K
GQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAKTECS

SEQ ID NO: 225 - protein, 106 aa, Artificial Sequence
  Synthetic: Antibody 05LC-T212K
GQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPKECS

SEQ ID NO: 226 - protein, 106 aa, Artificial Sequence
  Synthetic: Antibody 05LC-E213K
GQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTKCS

SEQ ID NO: 227 - protein, 106 aa, Artificial Sequence
  Synthetic: Antibody 05LC-S215K
GQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECK

SEQ ID NO: 228 - protein, 331 aa, Artificial Sequence
  Synthetic: Antibody 01HC-S191.K.S192
ASTKGPSVFPLAPSSKSTSGGTAALGCLVKDYFPEPVTVSWNSGALTSGVHTFPAVLQSSGLYSLSSVVTVPSSKSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 229 - protein, 331 aa, Artificial Sequence
  Synthetic: Antibody 01HC-S192.K.L193
ASTKGPSVFPLAPSSKSTSGGTAALGCLVKDYFPEPVTVSWNSGALTSGVHTFPAVLQSSGLYSLSSVVTVPSSSKLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 230 - protein, 331 aa, Artificial Sequence
  Synthetic: Antibody 01HC-L193.K.G194
ASTKGPSVFPLAPSSKSTSGGTAALGCLVKDYFPEPVTVSWNSGALTSGVHTFPAVLQSSGLYSLSSVVTVPSSSLKGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 231 - protein, 108 aa, Artificial Sequence
  Synthetic: Antibody 01-LC-K
RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECK

SEQ ID NO: 232 - protein, 109 aa, Artificial Sequence
  Synthetic: Antibody 01-LC-KL
RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECKL

SEQ ID NO: 233 - protein, 109 aa, Artificial Sequence
  Synthetic: Antibody 01-LC-LK
RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECLK

SEQ ID NO: 234 - protein, 110 aa, Artificial Sequence
  Synthetic: Antibody 01-LC-LKL
RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECLKL

SEQ ID NO: 235 - protein, 112 aa, Artificial Sequence
  Synthetic: Antibody 01-LC-GGSGK
RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGSGK

SEQ ID NO: 236 - protein, 113 aa, Artificial Sequence
  Synthetic: Antibody 01-LC-GGSGKL
RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGSGKL

SEQ ID NO: 237 - protein, 331 aa, Artificial Sequence
  Synthetic: Antibody 01HC-T135K-L448HC
ASTKGPSVFPLAPSSKSKSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKL

SEQ ID NO: 238 - protein, 330 aa, Artificial Sequence
  Synthetic: Antibody 01HC-S136K-N297K
ASTKGPSVFPLAPSSKSTKGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYKSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 239 - protein, 330 aa, Artificial Sequence
  Synthetic: Antibody 01HC-S136K-N297K-P445K
ASTKGPSVFPLAPSSKSTKGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYKSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSKGK

SEQ ID NO: 240 - protein, 212 aa, Artificial Sequence
  Synthetic: hu IgG2
AGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 241 - protein, 212 aa, Artificial Sequence
  Synthetic: hu IgG3
GGPSVFLFPPKPKDTLMISRTPEVTCVVVDVSHEDPEVQFKWYVDGVEVHNAKTKPREEQYNSTFRVVSVLTVLHQDWLNGKEYKCKVSNKALPAPIEKTISKTKGQPREPQVYTLPPSREEMTKNQVSLTCLVKGFYPSDIAVEWESSGQPENNYNTTPPMLDSDGSFFLYSKLTVDKSRWQQGNIFSCSVMHEALHNRFTQKSLSLSPGK

SEQ ID NO: 242 - protein, 212 aa, Artificial Sequence
  Synthetic: hu IgG4
GGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 243 - protein, 326 aa, Artificial Sequence
  Synthetic: Antibody 01IgG2HC
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 244 - protein, 326 aa, Artificial Sequence
  Synthetic: Antibody 01IgG2HC-M252K
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLKISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 245 - protein, 326 aa, Artificial Sequence
  Synthetic: Antibody 01IgG2HC-N297K
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFKSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 246 - protein, 326 aa, Artificial Sequence
  Synthetic: Antibody 01IgG2HC-P445K
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSKGK

SEQ ID NO: 247 - protein, 377 aa, Artificial Sequence
  Synthetic: Antibody 01IgG3HC
ASTKGPSVFPLAPCSRSTSGGTAALGCLVKDYFPEPVTVSWNSGALTSGVHTFPAVLQSSGLYSLSSVVTVPSSSLGTQTYTCNVNHKPSNTKVDKRVELKTPLGDTTHTCPRCPEPKSCDTPPPCPRCPEPKSCDTPPPCPRCPEPKSCDTPPPCPRCPAPELLGGPSVFLFPPKPKDTLMISRTPEVTCVVVDVSHEDPEVQFKWYVDGVEVHNAKTKPREEQYNSTFRVVSVLTVLHQDWLNGKEYKCKVSNKALPAPIEKTISKTKGQPREPQVYTLPPSREEMTKNQVSLTCLVKGFYPSDIAVEWESSGQPENNYNTTPPMLDSDGSFFLYSKLTVDKSRWQQGNIFSCSVMHEALHNRFTQKSLSLSPGK

SEQ ID NO: 248 - protein, 377 aa, Artificial Sequence
  Synthetic: Antibody 01IgG3HC-M252K
ASTKGPSVFPLAPCSRSTSGGTAALGCLVKDYFPEPVTVSWNSGALTSGVHTFPAVLQSSGLYSLSSVVTVPSSSLGTQTYTCNVNHKPSNTKVDKRVELKTPLGDTTHTCPRCPEPKSCDTPPPCPRCPEPKSCDTPPPCPRCPEPKSCDTPPPCPRCPAPELLGGPSVFLFPPKPKDTLKISRTPEVTCVVVDVSHEDPEVQFKWYVDGVEVHNAKTKPREEQYNSTFRVVSVLTVLHQDWLNGKEYKCKVSNKALPAPIEKTISKTKGQPREPQVYTLPPSREEMTKNQVSLTCLVKGFYPSDIAVEWESSGQPENNYNTTPPMLDSDGSFFLYSKLTVDKSRWQQGNIFSCSVMHEALHNRFTQKSLSLSPGK

SEQ ID NO: 249 - protein, 377 aa, Artificial Sequence
  Synthetic: Antibody 01IgG3HC-N297K
ASTKGPSVFPLAPCSRSTSGGTAALGCLVKDYFPEPVTVSWNSGALTSGVHTFPAVLQSSGLYSLSSVVTVPSSSLGTQTYTCNVNHKPSNTKVDKRVELKTPLGDTTHTCPRCPEPKSCDTPPPCPRCPEPKSCDTPPPCPRCPEPKSCDTPPPCPRCPAPELLGGPSVFLFPPKPKDTLMISRTPEVTCVVVDVSHEDPEVQFKWYVDGVEVHNAKTKPREEQYKSTFRVVSVLTVLHQDWLNGKEYKCKVSNKALPAPIEKTISKTKGQPREPQVYTLPPSREEMTKNQVSLTCLVKGFYPSDIAVEWESSGQPENNYNTTPPMLDSDGSFFLYSKLTVDKSRWQQGNIFSCSVMHEALHNRFTQKSLSLSPGK

SEQ ID NO: 250 - protein, 377 aa, Artificial Sequence
  Synthetic: Antibody 01IgG3HC-P445K
ASTKGPSVFPLAPCSRSTSGGTAALGCLVKDYFPEPVTVSWNSGALTSGVHTFPAVLQSSGLYSLSSVVTVPSSSLGTQTYTCNVNHKPSNTKVDKRVELKTPLGDTTHTCPRCPEPKSCDTPPPCPRCPEPKSCDTPPPCPRCPEPKSCDTPPPCPRCPAPELLGGPSVFLFPPKPKDTLMISRTPEVTCVVVDVSHEDPEVQFKWYVDGVEVHNAKTKPREEQYNSTFRVVSVLTVLHQDWLNGKEYKCKVSNKALPAPIEKTISKTKGQPREPQVYTLPPSREEMTKNQVSLTCLVKGFYPSDIAVEWESSGQPENNYNTTPPMLDSDGSFFLYSKLTVDKSRWQQGNIFSCSVMHEALHNRFTQKSLSLSKGK

SEQ ID NO: 251 - protein, 327 aa, Artificial Sequence
  Synthetic: Antibody 01IgG4HC
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 252 - protein, 327 aa, Artificial Sequence
  Synthetic: Antibody 01IgG4HC-M252K
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLKISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 253 - protein, 327 aa, Artificial Sequence
  Synthetic: Antibody 01IgG4HC-N297K
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFKSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 254 - protein, 327 aa, Artificial Sequence
  Synthetic: Antibody 01IgG4HC-L445K
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSKGK

SEQ ID NO: 255 - protein, 119 aa, Artificial Sequence
  Synthetic: Antibody 01FabHC
ASTKGPSVFPLAPSSKSTSGGTAALGCLVKDYFPEPVTVSWNSGALTSGVHTFPAVLQSSGLYSLSSVVTVPSSKSLGTQTYICNVNHKPSNTKVDKKVEPKSCDKTHTAPPAPAPELL

SEQ ID NO: 256 - protein, 119 aa, Artificial Sequence
  Synthetic: Antibody 01FabHC-D221A
ASTKGPSVFPLAPSSKSTSGGTAALGCLVKDYFPEPVTVSWNSGALTSGVHTFPAVLQSSGLYSLSSVVTVPSSKSLGTQTYICNVNHKPSNTKVDKKVEPKSCAKTHTAPPAPAPELL

SEQ ID NO: 257 - protein, 119 aa, Artificial Sequence
  Synthetic: Antibody 01FabHC-D221K
ASTKGPSVFPLAPSSKSTSGGTAALGCLVKDYFPEPVTVSWNSGALTSGVHTFPAVLQSSGLYSLSSVVTVPSSKSLGTQTYICNVNHKPSNTKVDKKVEPKSCKKTHTAPPAPAPELL

SEQ ID NO: 258 - protein, 119 aa, Artificial Sequence
  Synthetic: Antibody 01FabHC-T223K
ASTKGPSVFPLAPSSKSTSGGTAALGCLVKDYFPEPVTVSWNSGALTSGVHTFPAVLQSSGLYSLSSVVTVPSSKSLGTQTYICNVNHKPSNTKVDKKVEPKSCDKKHTAPPAPAPELL

SEQ ID NO: 259 - protein, 108 aa, Artificial Sequence
  Synthetic: Antibody 01FabHC-T223K-H
ASTKGPSVFPLAPSSKSTSGGTAALGCLVKDYFPEPVTVSWNSGALTSGVHTFPAVLQSSGLYSLSSVVTVPSSKSLGTQTYICNVNHKPSNTKVDKKVEPKSCDKKH

SEQ ID NO: 260 - protein, 119 aa, Artificial Sequence
  Synthetic: Antibody 01FabHC-H224K
ASTKGPSVFPLAPSSKSTSGGTAALGCLVKDYFPEPVTVSWNSGALTSGVHTFPAVLQSSGLYSLSSVVTVPSSKSLGTQTYICNVNHKPSNTKVDKKVEPKSCDKTKTAPPAPAPELL

SEQ ID NO: 261 - protein, 109 aa, Artificial Sequence
  Synthetic: Antibody 01FabHC-H224K-T
ASTKGPSVFPLAPSSKSTSGGTAALGCLVKDYFPEPVTVSWNSGALTSGVHTFPAVLQSSGLYSLSSVVTVPSSKSLGTQTYICNVNHKPSNTKVDKKVEPKSCDKTKT

SEQ ID NO: 262 - protein, 119 aa, Artificial Sequence
  Synthetic: Antibody 01FabHC-T225K
ASTKGPSVFPLAPSSKSTSGGTAALGCLVKDYFPEPVTVSWNSGALTSGVHTFPAVLQSSGLYSLSSVVTVPSSKSLGTQTYICNVNHKPSNTKVDKKVEPKSCDKTHKAPPAPAPELL

SEQ ID NO: 263 - protein, 110 aa, Artificial Sequence
  Synthetic: Antibody 01FabHC-T225K-A
ASTKGPSVFPLAPSSKSTSGGTAALGCLVKDYFPEPVTVSWNSGALTSGVHTFPAVLQSSGLYSLSSVVTVPSSKSLGTQTYICNVNHKPSNTKVDKKVEPKSCDKTHKA

SEQ ID NO: 264 - protein, 119 aa, Artificial Sequence
  Synthetic: Antibody 01FabHC-C226K
ASTKGPSVFPLAPSSKSTSGGTAALGCLVKDYFPEPVTVSWNSGALTSGVHTFPAVLQSSGLYSLSSVVTVPSSKSLGTQTYICNVNHKPSNTKVDKKVEPKSCDKTHTKPPAPAPELL

SEQ ID NO: 265 - protein, 119 aa, Artificial Sequence
  Synthetic: Antibody 01FabHC-C226K,P228A
ASTKGPSVFPLAPSSKSTSGGTAALGCLVKDYFPEPVTVSWNSGALTSGVHTFPAVLQSSGLYSLSSVVTVPSSKSLGTQTYICNVNHKPSNTKVDKKVEPKSCDKTHTKAPAPAPELL

SEQ ID NO: 266 - protein, 119 aa, Artificial Sequence
  Synthetic: Antibody 01FabHC-P227K
ASTKGPSVFPLAPSSKSTSGGTAALGCLVKDYFPEPVTVSWNSGALTSGVHTFPAVLQSSGLYSLSSVVTVPSSKSLGTQTYICNVNHKPSNTKVDKKVEPKSCDKTHTAKPAPAPELL

SEQ ID NO: 267 - protein, 119 aa, Artificial Sequence
  Synthetic: Antibody 01FabHC-P227K,P228A
ASTKGPSVFPLAPSSKSTSGGTAALGCLVKDYFPEPVTVSWNSGALTSGVHTFPAVLQSSGLYSLSSVVTVPSSKSLGTQTYICNVNHKPSNTKVDKKVEPKSCDKTHTAKAAPAPELL

SEQ ID NO: 268 - protein, 119 aa, Artificial Sequence
  Synthetic: Antibody 01FabHC-P228K
ASTKGPSVFPLAPSSKSTSGGTAALGCLVKDYFPEPVTVSWNSGALTSGVHTFPAVLQSSGLYSLSSVVTVPSSKSLGTQTYICNVNHKPSNTKVDKKVEPKSCDKTHTAPKAPAPELL

SEQ ID NO: 269 - protein, 113 aa, Artificial Sequence
  Synthetic: Antibody 01FabHC-P228K-A
ASTKGPSVFPLAPSSKSTSGGTAALGCLVKDYFPEPVTVSWNSGALTSGVHTFPAVLQSSGLYSLSSVVTVPSSKSLGTQTYICNVNHKPSNTKVDKKVEPKSCDKTHTAPKA

SEQ ID NO: 270 - protein, 119 aa, Artificial Sequence
  Synthetic: Antibody 01FabHC-C229K
ASTKGPSVFPLAPSSKSTSGGTAALGCLVKDYFPEPVTVSWNSGALTSGVHTFPAVLQSSGLYSLSSVVTVPSSKSLGTQTYICNVNHKPSNTKVDKKVEPKSCDKTHTAPPKPAPELL

SEQ ID NO: 271 - protein, 119 aa, Artificial Sequence
  Synthetic: Antibody 01FabHC-C229K,P230A
ASTKGPSVFPLAPSSKSTSGGTAALGCLVKDYFPEPVTVSWNSGALTSGVHTFPAVLQSSGLYSLSSVVTVPSSKSLGTQTYICNVNHKPSNTKVDKKVEPKSCDKTHTAPPKAAPELL

SEQ ID NO: 272 - protein, 119 aa, Artificial Sequence
  Synthetic: Antibody 01FabHC-P230K
ASTKGPSVFPLAPSSKSTSGGTAALGCLVKDYFPEPVTVSWNSGALTSGVHTFPAVLQSSGLYSLSSVVTVPSSKSLGTQTYICNVNHKPSNTKVDKKVEPKSCDKTHTAPPAKAPELL

SEQ ID NO: 273 - protein, 115 aa, Artificial Sequence
  Synthetic: Antibody 01FabHC-P230K-A
ASTKGPSVFPLAPSSKSTSGGTAALGCLVKDYFPEPVTVSWNSGALTSGVHTFPAVLQSSGLYSLSSVVTVPSSKSLGTQTYICNVNHKPSNTKVDKKVEPKSCDKTHTAPPAKA

SEQ ID NO: 274 - protein, 119 aa, Artificial Sequence
  Synthetic: Antibody 01FabHC-A231K
ASTKGPSVFPLAPSSKSTSGGTAALGCLVKDYFPEPVTVSWNSGALTSGVHTFPAVLQSSGLYSLSSVVTVPSSKSLGTQTYICNVNHKPSNTKVDKKVEPKSCDKTHTAPPAPKPELL

SEQ ID NO: 275 - protein, 119 aa, Artificial Sequence
  Synthetic: Antibody 01FabHC-A231K,P232A
ASTKGPSVFPLAPSSKSTSGGTAALGCLVKDYFPEPVTVSWNSGALTSGVHTFPAVLQSSGLYSLSSVVTVPSSKSLGTQTYICNVNHKPSNTKVDKKVEPKSCDKTHTAPPAPKAELL

SEQ ID NO: 276 - protein, 119 aa, Artificial Sequence
  Synthetic: Antibody 01FabHC-P232K
ASTKGPSVFPLAPSSKSTSGGTAALGCLVKDYFPEPVTVSWNSGALTSGVHTFPAVLQSSGLYSLSSVVTVPSSKSLGTQTYICNVNHKPSNTKVDKKVEPKSCDKTHTAPPAPAKELL

SEQ ID NO: 277 - protein, 119 aa, Artificial Sequence
  Synthetic: Antibody 01FabHC-P232K,E233A
ASTKGPSVFPLAPSSKSTSGGTAALGCLVKDYFPEPVTVSWNSGALTSGVHTFPAVLQSSGLYSLSSVVTVPSSKSLGTQTYICNVNHKPSNTKVDKKVEPKSCDKTHTAPPAPAKALL

SEQ ID NO: 278 - protein, 119 aa, Artificial Sequence
  Synthetic: Antibody 01FabHC-E233K
ASTKGPSVFPLAPSSKSTSGGTAALGCLVKDYFPEPVTVSWNSGALTSGVHTFPAVLQSSGLYSLSSVVTVPSSKSLGTQTYICNVNHKPSNTKVDKKVEPKSCDKTHTAPPAPAPKLL

SEQ ID NO: 279 - protein, 118 aa, Artificial Sequence
  Synthetic: Antibody 01FabHC-E233K-L
ASTKGPSVFPLAPSSKSTSGGTAALGCLVKDYFPEPVTVSWNSGALTSGVHTFPAVLQSSGLYSLSSVVTVPSSKSLGTQTYICNVNHKPSNTKVDKKVEPKSCDKTHTAPPAPAPKL

SEQ ID NO: 280 - protein, 119 aa, Artificial Sequence
  Synthetic: Antibody 01FabHC-L234K
ASTKGPSVFPLAPSSKSTSGGTAALGCLVKDYFPEPVTVSWNSGALTSGVHTFPAVLQSSGLYSLSSVVTVPSSKSLGTQTYICNVNHKPSNTKVDKKVEPKSCDKTHTAPPAPAPEKL

SEQ ID NO: 281 - protein, 119 aa, Artificial Sequence
  Synthetic: Antibody 01FabHC-E233A,L234K
ASTKGPSVFPLAPSSKSTSGGTAALGCLVKDYFPEPVTVSWNSGALTSGVHTFPAVLQSSGLYSLSSVVTVPSSKSLGTQTYICNVNHKPSNTKVDKKVEPKSCDKTHTAPPAPAPAKL

SEQ ID NO: 282 - protein, 119 aa, Artificial Sequence
  Synthetic: Antibody 01FabHC-L235K
ASTKGPSVFPLAPSSKSTSGGTAALGCLVKDYFPEPVTVSWNSGALTSGVHTFPAVLQSSGLYSLSSVVTVPSSKSLGTQTYICNVNHKPSNTKVDKKVEPKSCDKTHTAPPAPAPELK

SEQ ID NO: 283 - protein, 330 aa, Artificial Sequence
  Synthetic: Antibody 01HC-N297Q
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 284 - protein, 19 aa, Artificial Sequence
  Synthetic: Signal sequence
MGWSCIILFLVATATGVHS

SEQ ID NO: 285 - protein, 4 aa, Artificial Sequence
  Synthetic: peptide
GGKL

SEQ ID NO: 286 - protein, 5 aa, Artificial Sequence
  Synthetic: peptide
GGSKL

SEQ ID NO: 287 - protein, 6 aa, Artificial Sequence
  Synthetic: peptide
GGSGKL

SEQ ID NO: 288 - protein, 330 aa, Homo sapiens [sequence omitted]

SEQ ID NO: 289 - protein, 107 aa, Homo sapiens [sequence omitted]

SEQ ID NO: 290 - protein, 106 aa, Homo sapiens; identical to SEQ ID NO: 20
  misc_feature (1)..(106): hu C(lambda)

SEQ ID NO: 291 - protein, 212 aa, Homo sapiens
  misc_feature (1)..(212): hu IgG1
GGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 292 - protein, 212 aa, Homo sapiens; identical to SEQ ID NO: 240
  misc_feature (1)..(212): hu IgG2

SEQ ID NO: 293 - protein, 212 aa, Homo sapiens; identical to SEQ ID NO: 241
  misc_feature (1)..(212): hu IgG3

SEQ ID NO: 294 - protein, 212 aa, Homo sapiens; identical to SEQ ID NO: 242
  misc_feature (1)..(212): hu IgG4

SEQ ID NO: 295 - protein, 7 aa, Artificial Sequence
  Synthetic: peptide
SSKSLGT

SEQ ID NO: 296 - protein, 7 aa, Artificial Sequence
  Synthetic: peptide
SSSKLGT

SEQ ID NO: 297 - protein, 7 aa, Artificial Sequence
  Synthetic: peptide
SSSLKGT

SEQ ID NO: 298 - protein, 5 aa, Artificial Sequence
  Synthetic: peptide
GGSGK

SEQ ID NO: 299 - protein, 14 aa, Artificial Sequence
  Synthetic: peptide
DTHTAPPAPAPELL

SEQ ID NO: 300 - protein, 15 aa, Artificial Sequence
  Synthetic: M9-Fab, T223K
DKKHTAPPAPAPELL

SEQ ID NO: 301 - protein, 15 aa, Artificial Sequence
  Synthetic: D221A
AKTHTAPPAPAPELL

SEQ ID NO: 302 - protein, 15 aa, Artificial Sequence
  Synthetic: D221K
KKTHTAPPAPAPELL

SEQ ID NO: 303 - protein, 4 aa, Artificial Sequence
  Synthetic: T223K-H
DKKH

SEQ ID NO: 304 - protein, 15 aa, Artificial Sequence
  Synthetic: H224K
DKTKTAPPAPAPELL

SEQ ID NO: 305 - protein, 5 aa, Artificial Sequence
  Synthetic: H224K-T
DKTKT

SEQ ID NO: 306 - protein, 15 aa, Artificial Sequence
  Synthetic: T225K
DKTHKAPPAPAPELL

SEQ ID NO: 307 - protein, 6 aa, Artificial Sequence
  Synthetic: T225K-A
DKTHKA

SEQ ID NO: 308 - protein, 15 aa, Artificial Sequence
  Synthetic: C226K
DKTHTKPPAPAPELL

SEQ ID NO: 309 - protein, 15 aa, Artificial Sequence
  Synthetic: C226K,P228A
DKTHTKAPAPAPELL

SEQ ID NO: 310 - protein, 15 aa, Artificial Sequence
  Synthetic: P227K
DKTHTAKPAPAPELL

SEQ ID NO: 311 - protein, 15 aa, Artificial Sequence
  Synthetic: P227K,P228A
DKTHTAKAAPAPELL

SEQ ID NO: 312 - protein, 15 aa, Artificial Sequence
  Synthetic: P228K
DKTHTAPKAPAPELL

SEQ ID NO: 313 - protein, 9 aa, Artificial Sequence
  Synthetic: P228K-A
DKTHTAPKA

SEQ ID NO: 314 - protein, 15 aa, Artificial Sequence
  Synthetic: C229K
DKTHTAPPKPAPELL

SEQ ID NO: 315 - protein, 15 aa, Artificial Sequence
  Synthetic: C229K,P230A
DKTHTAPPKAAPELL

SEQ ID NO: 316 - protein, 15 aa, Artificial Sequence
  Synthetic: P230K
DKTHTAPPAKAPELL

SEQ ID NO: 317 - protein, 11 aa, Artificial Sequence
  Synthetic: P230K-A
DKTHTAPPAKA

SEQ ID NO: 318 - protein, 15 aa, Artificial Sequence
  Synthetic: A231K
DKTHTAPPAPKPELL

SEQ ID NO: 319 - protein, 15 aa, Artificial Sequence
  Synthetic: A231K,P232A
DKTHTAPPAPKAELL

SEQ ID NO: 320 - protein, 15 aa, Artificial Sequence
  Synthetic: P232K
DKTHTAPPAPAKELL

SEQ ID NO: 321 - protein, 15 aa, Artificial Sequence
  Synthetic: P232K,E233A
DKTHTAPPAPAKALL

SEQ ID NO: 322 - protein, 15 aa, Artificial Sequence
  Synthetic: E233K
DKTHTAPPAPAPKLL

SEQ ID NO: 323 - protein, 14 aa, Artificial Sequence
  Synthetic: E233K-L
DKTHTAPPAPAPKL

SEQ ID NO: 324 - protein, 15 aa, Artificial Sequence
  Synthetic: L234K
DKTHTAPPAPAPEKL

SEQ ID NO: 325 - protein, 15 aa, Artificial Sequence
  Synthetic: E233A,L234K
DKTHTAPPAPAPAKL

SEQ ID NO: 326 - protein, 15 aa, Artificial Sequence
  Synthetic: L235K
DKTHTAPPAPAPELK

SEQ ID NO: 327 - protein, 5 aa, Artificial Sequence
  Synthetic: peptide
KSKSG

SEQ ID NO: 328 - protein, 5 aa, Artificial Sequence
  Synthetic: peptide
STKGG

SEQ ID NO: 329 - protein, 5 aa, Artificial Sequence
  Synthetic: peptide
SSKGT

SEQ ID NO: 330 - protein, 5 aa, Artificial Sequence
  Synthetic: peptide
TLKIS

SEQ ID NO: 331 - protein, 5 aa, Artificial Sequence
  Synthetic: peptide
QYKST

SEQ ID NO: 332 - protein, 4 aa, Artificial Sequence
  Synthetic: peptide
LSKG

SEQ ID NO: 333 - protein, 5 aa, Artificial Sequence
  Synthetic: peptide
QGKSS

SEQ ID NO: 334 - protein, 5 aa, Artificial Sequence
  Synthetic: peptide
GLKSP

SEQ ID NO: 335 - protein, 5 aa, Artificial Sequence
  Synthetic: peptide
PTKCS

SEQ ID NO: 336 - protein, 5 aa, Artificial Sequence
  Synthetic: peptide
SSKST

SEQ ID NO: 337 - protein, 5 aa, Artificial Sequence
  Synthetic: peptide
LTKNQ

SEQ ID NO: 338 - protein, 5 aa, Artificial Sequence
  Synthetic: peptide
QLKSG

SEQ ID NO: 339 - protein, 5 aa, Artificial Sequence
  Synthetic: peptide
LSKAD

The invention claimed is:
1. A conjugated immunoglobulin comprising an immunoglobulin, or antigen-binding portion thereof, and a functional agent, wherein
a) the immunoglobulin, or antigen-binding portion thereof, comprises an engineered lysine residue, wherein the engineered lysine residue is a natural amino acid residue which has been mutated to a lysine residue,
wherein the natural amino acid residue which has been mutated to a lysine residue is selected from the group consisting of:
Threonine 135 (T135K), Serine 136 (S136K), Leucine 193 (L193K), Aspartic acid 221 (D221K), Threonine 223 (T223K), Histidine 224 (H224K), Threonine 225 (T225K), Methionine 252 (M252K), Asparagine 297 (N297K), and Proline 445 (P445K) on a heavy chain of the immunoglobulin, or antigen-binding portion thereof,
Leucine 201 (L201K) and Serine 202 (S202K) on a kappa light chain of the immunoglobulin, or antigen-binding portion thereof, and
Glutamic acid 213 (E213K) on a lambda light chain of the immunoglobulin, or antigen-binding portion thereof;
wherein the amino acid residues are numbered according to the EU numbering system;
b) the engineered lysine residue is conjugated to a glutamine residue on an acyl donor substrate, wherein the acyl donor substrate further comprises a reactive group, wherein the acyl donor substrate is according to one Formulae (III) or (IV):

   (III)

   (IV)

wherein
Z is a carboxylbenzyloxy (CBZ) group or an amino acid residue;
Gln is a glutamine amino acid residue;
each L is independently a straight or branched linker from 1 to 20 carbon atoms, wherein one or more of the carbon atoms may be optionally and independently replaced with a nitrogen, oxygen or sulfur atom, and wherein each carbon and nitrogen atom may be optionally substituted; or each L is optionally and independently an amino acid residue;
m is an integer from 0 to 5;
n is an integer from 0 to 5; and
X is a reactive group;
c) the reactive group is conjugated to a functional agent, wherein the functional agent is a therapeutic agent or a diagnostic agent.
2. A pharmaceutical composition comprising the conjugated immunoglobulin of claim 1, and a pharmaceutically acceptable carrier.
3. The conjugated immunoglobulin of claim 1, wherein the heavy chain further comprises an amino acid residue which has been added to its C-terminus at position 448, and wherein said amino acid residue is not proline or an acidic amino acid residue.
4. The conjugated immunoglobulin of claim 3, wherein the at least one amino acid residue which has been added to the C-terminus at position 448 is leucine.
5. The conjugated immunoglobulin of claim 1, wherein the immunoglobulin, or antigen-binding portion thereof, further comprises a second engineered lysine residue, wherein the second engineered lysine residue is a second lysine residue insertion or a second natural amino acid residue which has been mutated to a lysine residue, and wherein the second engineered lysine residue is conjugated to the glutamine residue of the acyl donor substrate.
6. The conjugated immunoglobulin of claim 5,
wherein the natural amino acid residue which has been mutated to the engineered lysine residue is Threonine 135 (T135K) on a heavy chain of the immunoglobulin, or antigen-binding portion thereof, and the second natural amino acid residue which has been mutated to the second engineered lysine residue is Leucine 201 (L201K) on a kappa light chain of the immunoglobulin, or antigen-binding portion thereof; or
wherein the natural amino acid residue which has been mutated to the engineered lysine residue is Threonine 135 (T135K) on a heavy chain of the immunoglobulin, or antigen-binding portion thereof, and the second natural amino acid residue which has been mutated to the second engineered lysine residue is Serine 202 (S202K) on a kappa light chain of the immunoglobulin, or antigen-binding portion thereof;
wherein the amino acid residues are numbered according to the EU numbering system.
7. The conjugated immunoglobulin of claim 6, wherein the heavy chain further comprises at least one amino acid residue which has been added to its C-terminus at position 448, and wherein the at least one amino acid residue is not proline or an acidic amino acid residue.
8. The conjugated immunoglobulin of claim 7, wherein the at least one amino acid residue which has been added to the C-terminus at position 448 is leucine.
9. The conjugated immunoglobulin of claim 5, wherein the immunoglobulin, or antigen-binding portion thereof, further comprises a third engineered lysine residue, wherein the third engineered lysine residue is a third lysine residue insertion or a third natural amino acid residue which has been mutated to a lysine residue, and wherein the third engineered lysine residue is conjugated to the glutamine residue of the acyl donor substrate.
10. The conjugated immunoglobulin of claim 9, wherein the immunoglobulin, or antigen-binding portion thereof, further comprises a fourth engineered lysine residue, wherein the fourth engineered lysine residue is a fourth lysine residue insertion or a fourth natural amino acid residue which has been mutated to a lysine residue, and wherein the fourth engineered lysine residue is conjugated to the glutamine residue of the acyl donor substrate.
11. The conjugated immunoglobulin of claim 1, wherein the immunoglobulin, or antigen-binding portion thereof, comprises a heavy chain which further comprises at least one amino acid residue which has been added to its C-terminus at position 448, and wherein the at least one amino acid residue is not proline or an acidic amino acid residue.
12. The conjugated immunoglobulin of claim 11, wherein the amino acid residue which has been added to the C-terminus at position 448 is leucine.
13. The conjugated immunoglobulin of claim 1, wherein the immunoglobulin, or antigen-binding portion thereof, comprises a light chain which comprises an insertion of one to four additional amino acids after cysteine 214, wherein the lysine residue insertion is a lysine residue which has been inserted after the one to four additional amino acids, and wherein a leucine residue has been inserted after the lysine residue.
14. The conjugated immunoglobulin of claim 13, wherein the insertion of one to four additional amino acids after cysteine 214, the lysine residue which has been inserted after the one to four additional amino acids, and the leucine residue which has been inserted after the lysine residue comprise a sequence selected from the group consisting of: GKL, GGKL, GGSKL, and GGSGKL.

15. The conjugated immunoglobulin of claim 1, wherein the acyl donor substrate is according to formula (III), and wherein Z is a CBZ group; wherein each L is independently a polyethylene glycol moiety (PEG) (—O((CH$_2$)$_2$)—), ethyl amine (—NH((CH$_2$)$_2$)—) or propyl amine (—NH((CH$_2$)$_3$)—); and wherein n is 0, 1, 2, 3, 4, or 5; or
wherein the acyl donor substrate is according to formula (III), wherein Z is a CBZ group, and wherein one or more L is an amino acid; or
wherein the acyl donor substrate is according to formula (IV), wherein Z is a CBZ group; m is 1; n is 1, 2 or 3; and at least one L is Gly.

16. The conjugated immunoglobulin of claim 15,
wherein L is Gly; m is 1; and n is 1; or
wherein m is 1; and n is 0.

17. The conjugated immunoglobulin of claim 1, wherein X is a reactive group selected from the group consisting of (1R,8S,9s)-bicyclo[6.1.0]non-4-yn-9-ylmethanol (BCN),

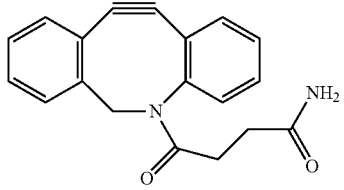

(dibenzocyclooctyne; DBCO), trans-cyclooctene (TCO), azido (N$_3$), alkyne, tetrazine methylcyclopropene, norbornene, hydrazide/hydrazine, and aldehyde.

18. The conjugated immunoglobulin of claim 1,
wherein the therapeutic agent is an antibody or antigen-binding portion thereof, a chemotherapeutic agent, a drug agent, a radioactive agent, a cytotoxic agent, an antibiotic, a small molecule, a nucleic acid, or a polypeptide; or
wherein the diagnostic agent is a fluorophore, a fluorescent dye, a radionuclide, or an enzyme.

19. The conjugated immunoglobulin of claim 1, wherein the immunoglobulin, or antigen-binding portion thereof
(i) is an IgG$_1$ immunoglobulin, or antigen-binding portion thereof; or
(ii) is an IgG$_2$, IgG$_3$, or IgG$_4$ immunoglobulin, or antigen-binding portion thereof;
or (iii) is an IgA$_1$, an IgA$_2$, or an IgM immunoglobulin, or antigen-binding portion thereof; or
(iv) is an IgD or IgE, immunoglobulin, or antigen-binding portion thereof; or
(v) is a fragment-antigen binding (Fab); or
(vi) is a human immunoglobulin, or antigen-binding portion thereof, or a humanized immunoglobulin, or antigen-binding portion thereof; or
(vii) is a chimeric immunoglobulin, or antigen-binding portion thereof, or a non-human immunoglobulin, or antigen-binding portion thereof; or
(viii) comprises two heavy chains and two light chains.

20. The conjugated immunoglobulin of claim 1, wherein the ratio of the functional agent to immunoglobulin, or antigen-binding portion thereof, is 1:1 to 100:1 or 1:1 to 200:1.

21. A method for generating a conjugated immunoglobulin, the method comprising:
i) contacting an immunoglobulin, or antigen-binding portion thereof, with a microbial transglutaminase and an acyl donor substrate,
a) wherein the immunoglobulin, or antigen-binding portion thereof, comprises an engineered lysine residue, wherein the engineered lysine residue is a natural amino acid residue which has been mutated to a lysine residue,
wherein the natural amino acid residue which has been mutated to a lysine residue is selected from the group consisting of:
Threonine 135 (T135K), Serine 136 (S136K), Leucine 193 (L193K), Aspartic acid 221 (D221K), Threonine 223 (T223K), Histidine 224 (H224K), Threonine 225 (T225K), Methionine 252 (M252K), Asparagine 297 (N297K), and Proline 445 (P445K) on a heavy chain of the immunoglobulin, or antigen-binding portion thereof,
Leucine 201 (L201K) and Serine 202 (S202K) on a kappa light chain of the immunoglobulin, or antigen-binding portion thereof, and
Glutamic acid 213 (E213K) on a lambda light chain of the immunoglobulin, or antigen-binding portion thereof;
wherein the amino acid residues are numbered according to the EU numbering system;
and
b) wherein the acyl donor substrate comprises a glutamine residue and a reactive group,
wherein the acyl donor substrate is according to one Formulae (III) or (IV):

$$(Z)_m\text{-Gln-}(L)_n\text{-}(X) \qquad (III)$$

$$(X)\text{-}(L)_n\text{-Gln-}(Z)_m \qquad (IV)$$

wherein
Z is a carboxylbenzyloxy (CBZ) group or an amino acid residue;
Gln is a glutamine amino acid residue;
each L is independently a straight or branched linker from 1 to 20 carbon atoms, wherein one or more of the carbon atoms may be optionally and independently replaced with a nitrogen, oxygen or sulfur atom, and wherein each carbon and nitrogen atom may be optionally substituted; or each L is optionally and independently an amino acid residue;
m is an integer from 0 to 5;
n is an integer from 0 to 5; and
X is a reactive group;
wherein the microbial transglutaminase conjugates the engineered lysine residue of the immunoglobulin, or antigen-binding portion thereof, to the glutamine residue of the acyl donor substrate, and
ii) conjugating a functional agent to the reactive group of the acyl donor substrate, wherein the functional agent is a therapeutic agent or a diagnostic agent, thereby generating the conjugated immunoglobulin.

22. The method of claim 21, wherein the reactive group of the acyl donor substrate is conjugated to the functional agent by click chemistry.

23. The conjugated immunoglobulin of claim 1, wherein the natural amino acid residue which has been mutated to a lysine residue is Threonine 135 (T135K) on a heavy chain of the immunoglobulin, or antigen-binding portion thereof.

24. The conjugated immunoglobulin of claim 1, wherein the natural amino acid residue which has been mutated to a lysine residue is Leucine 193 (L193K) on a heavy chain of the immunoglobulin, or antigen-binding portion thereof.

25. The conjugated immunoglobulin of claim 1, wherein the natural amino acid residue which has been mutated to a lysine residue is Proline 445 (P445K) on a heavy chain of the immunoglobulin, or antigen-binding portion thereof.

\* \* \* \* \*